US008283122B2

(12) United States Patent
Khan et al.

(10) Patent No.: US 8,283,122 B2
(45) Date of Patent: Oct. 9, 2012

(54) PREDICTION OF CLINICAL OUTCOME USING GENE EXPRESSION PROFILING AND ARTIFICIAL NEURAL NETWORKS FOR PATIENTS WITH NEUROBLASTOMA

(75) Inventors: Javed Khan, Derwood, MD (US); Jun S. Wei, Gaithersburg, MD (US); Braden T. Greer, Gaithersburg, MD (US)

(73) Assignee: The United States of America, as Represented by the Secretary of the Department of Health and Human Services, Washington, DC (US)

( * ) Notice: Subject to any disclaimer, the term of this patent is extended or adjusted under 35 U.S.C. 154(b) by 977 days.

(21) Appl. No.: 11/572,667

(22) PCT Filed: Aug. 3, 2005

(86) PCT No.: PCT/US2005/027660
§ 371 (c)(1),
(2), (4) Date: Apr. 28, 2009

(87) PCT Pub. No.: WO2006/026051
PCT Pub. Date: Mar. 9, 2007

(65) Prior Publication Data
US 2009/0215033 A1    Aug. 27, 2009

Related U.S. Application Data

(60) Provisional application No. 60/598,728, filed on Aug. 3, 2004.

(51) Int. Cl.
*C12Q 1/68* (2006.01)
(52) U.S. Cl. ...................................... 435/6.14
(58) Field of Classification Search .................. None
See application file for complete search history.

(56) References Cited

U.S. PATENT DOCUMENTS

| | | | |
|---|---|---|---|
| 5,225,539 | A | 7/1993 | Winter |
| 5,644,031 | A | 7/1997 | Laborda |
| 6,331,415 | B1 | 12/2001 | Cabilly et al. |
| 6,794,137 | B2 | 9/2004 | Blumenberg |
| 7,087,383 | B2 | 8/2006 | Nakagawara |
| 7,229,774 | B2 | 6/2007 | Chinnalyan et al. |
| 2003/0207278 | A1 | 11/2003 | Khan et al. |
| 2004/0009154 | A1 | 1/2004 | Khan et al. |
| 2006/0188919 | A1 | 8/2006 | Nakagawara |

FOREIGN PATENT DOCUMENTS
EP     1 683 862 A1    7/2006

OTHER PUBLICATIONS

Khan et al., "Classification and diagnostic prediction of cancers using gene expression profiling and artificial neural networks", *Nature Medicine*, 7(6):673-679 (2001).
Barrett et al., "Microarrays: the use of oligonucleotides and cDNA for the analysis of gene expression", *Drug Discovery Today*, 8(3):134-141 (2003).
Berwanger et al., "Loss of a FYN-regulated Differentiation and growth arrest pathway in advanced stage neuroblastoma", *Cancer Cell*, 2:377-386 (2002).
Brodeur, "Neuroblastoma: Biological Insights Into a Clinical Enigma", *Nat. Rev. Cancer*, 3:203-216 (2003).
Chen et al., "Ratio-Based Decisions and the Quantitative Analysis of cDNA Microarray Images", *J. of Biomedical Optics*, 2:364-374 (1997).
Chen et al., "Ratio statistics of gene expression levels and applications to microarray data analysis", *Bioinformatics*, 18(9):1207-1215 (2002).
Cox, "Regression Models and Life-Tables", *J. Royal Stat. Soc. (B)*, 34:187-220 (1972).
Furey et al., *Bioinformatics*, 16(10):906-914 (2000).
Fisher et al., "Differential Expression of Neuronal Genes Defines Subtypes of Disseminated Neuroblastoma with Favorable and Unfavorable Outcome", *Clin. Cancer Res.*, 12(17):5118-5128 (2006).
Golub, T. et al., "Molecular Classification of Cancer: Class Discovery and Class Prediction by Gene Expression Monitoring", *Science*, 286:531-537 (1999).
Gruvberger, S. et al., "Estrogen Receptor Status in Breast Cancer is Associated with Remarkably Distinct Gene Expression Patterns", *Cancer Research*, 61:5979-5984 (2001).
Hegde et al., "A Concise Guide to cDNA Microarray Analysis", *Biotechniques*, 29:548-550, 552-544, 556 (2000).
Herrero et al., *Bioinformatics*, 17(2):126-136 (2001).
Kaplan et al., "Measuring Recessions", *J. Am. Stat. Assoc.*, 53:457-481 (1958).
Köhler et al., "Derivation of specific antibody-producing tissue culture and tumor lines by cell fusion", *Eur. J. Immun.*, 6:511-519 (1976).
Kwon, S. et al., "DNA Microarray Data Analysis for Cancer Classification Based on Stepwise Discriminant Analysis and Bayesian Decision Theory", *Genome Informatics*, 12:252-254 (2001).

(Continued)

*Primary Examiner* — James Martinell
(74) *Attorney, Agent, or Firm* — Edwards Wildman Palmer LLP; Peter F. Corless; Andrew W. Shyjan, Esq.

(57) ABSTRACT

A method of predicting the outcome of a patient with neuroblastoma that includes obtaining experimental data on gene selections. The gene selection functions to predict the outcome of a patient with neuroblastoma when the expression of that gene selection is compared to the identical selection from a non-neuroblastoma cell or a different type of neuroblastoma cell. The invention also includes a method of targeting at least one product of a gene that includes administration of a therapeutic agent. The invention also includes the use of a gene selection for predicting the outcome of patient with neuroblastoma.

24 Claims, 18 Drawing Sheets

OTHER PUBLICATIONS

Strausberg et al., "Generation and initial analysis of more than 15,000 full-length human and mouse cDNA sequences", *PNAS*, 99(26):16899-16903 (2002).

Mantel, "Evaluation of Survival Data and Two New Rank Order Statistics Arising in its Consideration", *Cancer Chem. Rep.*, 50:163-170 (1966).

Muller et al., *IEEE Transactions on Neural Networks*, 12(2):181-201 (2001).

NHGRI Protocol, http://www.nhgri.hih.gov/DIR/LGG/SK/HTML/protocol.html, 27 pages (Apr. 25, 2002).

Ohira et al., "Hunting the Subset-Specific Genes of Neuroblastoma: Expression Profiling and Differential Screening of the Full-Length-Enriched Oligo-Capping cDNA Libraries", *Medical and Pediatric Oncology*, 35:547-549 (2000).

Ohira et al., "Expression profiling and characterization of 4200 genes cloned from primary neuroblastomas: identification of 305 genes differentially expressed between favorable and unfavorable subsets", *Oncogene*, 22:5525-5536 (2003).

Raychaudhuri et al., *Trends in Biotechnology*, 19(5):189-193 (2001).

Schramm et al., "Prediction of clinical outcome and biological characterization of neuroblastoma by expression profiling", *Oncogene*, 24:7902-7912 (2005).

Schwab et al., "Neuroblastoma: biology and molecular and chromosomal pathology", *Oncology*, 4:472-480 (2003).

SCORE Sequence Search Results/Alignment pp. 1-4, Accession No. BC007741,(Jul. 15, 2006).

Simon et al., "Statistical aspects of prognostic factor studies in oncology", *Br. J. Cancer*, 69:979-985 (1994).

Sotiriou et al., "Core Biopsies Can Be Used to Distinguish Differences in Expression Profiling by cDNA Microarrays", *J. Mol. Diagn.*, 4:30-36 (2002).

Sturn et al., "Genesis: cluster analysis of microarray data", *Bioinformatics*, 18(1):207-208 (2002).

Tusher et al., "Significance analysis of rnicroarrays applied to the ionizing radiation response", *Proc. Natl. Acad. Sci. USA*, 98(9):5116-5121 (2001).

Van Gelder et al., "Amplified RNA synthesized from limited quantities of heterogeneous cDNA", *Proc. Natl. Acad. Sci. USA*, 87:1663-1667 (1990).

Van Limpt et al., "SAGE Analysis of Neuroblastoma Reveals a High Expression of the Human Homologue of the *Drosophila Delta* Gene", *Medical and Pediatric Oncology*, 35:554-558 (2000).

Wei et al., "Prediction of Clinical Outcome Using Gene Expression Profiling and Artificial Neural Networks for Patients with Neuroblastoma", *Cancer Res.*, 64:6883 (2004).

International Search Report mailed May 10, 2007.

Westermann et al., "Genetic parameters of neuroblastomas", *Cancer Letters*,184:127-147 (2002).

Winter et al., "Making Antibodies by Phage Display Technology", *Ann. Rev. of Immunol.*, 12:433-455 (1994).

Hillier et al., "Generation and analysis of 280,000 human expressed sequence tags", GenBank Accession No. AA004638 (Jun. 24, 1996).

Hillier et al., "The WashU-Merck EST Project", GenBank Accession No. AA025819 (Aug. 14, 2996).

Hillier et al., "Generation of analysis of 280,00 human expressed sequence tags", GenBank Accession No. AA029597 (Mar. 29, 1996).

Hillier et al., "Generation and analysis of 280,000 human expressed sequence tags", GenBank Accession No. AA034366 (Mar. 29, 1996).

Hillier et al., "Generation and analysis of 280,000 human expressed sequence tags", GenBank Accession No. AA041400 (Mar. 29, 1996).

Hillier et al., "Generation and analysis of 280,000 human expressed sequence tags", GenBank Accession No. AA044023 (Aug. 21, 1996).

Hillier et al., "Generation and analysis of 280,000 human expressed sequence tags", GenBank Accession No. AA055534 (Mar. 29, 1996).

Hillier et al., "Generation and analysis of 280,000 human expressed sequence tags", GenBank Accession No. AA071005 (Sep. 6, 1996).

Hillier et al., "Generation and analysis of 280,000 human expressed sequence tags", GenBank Accession No. AA133350 (Nov. 15, 1996).

Hillier et al., "Generation and analysis of 280,000 human expressed sequence tags", GenBank Accession No. AA155913 (Dec. 11, 1996).

Hillier et al., "Generation and analysis of 280,000 human expressed sequence tags", GenBank Accession No. AA156674 (Nov. 15, 1996).

Hillier et al., "WashU-NCI human EST Project", GenBank Accession No. AA158584 (Sep. 30, 1997).

Hillier et al., "WashU-NCI human EST Project", GenBank Accession No. AA188378 (Jan. 6, 1997).

Hillier et al., "WashU-Merck EST Project 1997", GenBank Accession No. AA232953 (Nov. 27, 1996).

Hillier et al., "Generation and analysis of 280,000 human expressed sequence tags", GenBank Accession No. AA235116 (Mar. 17, 1997).

Hillier et al., "The WashU-Merck EST Project", GenBank Accession No. AA235370 (Mar. 3, 1997).

Hillier et al., "WashU-Merck EST Project 1997", GenBank Accession No. AA256176 (Mar. 3, 1997).

Hillier et al., "Generation and analysis of 280,000 human expressed sequence tags", GenBank Accession No. AA394198 (Apr. 2, 1997).

Hillier et al., "Generation and analysis of 280,000 human expressed sequence tags", GenBank Accession No. AA397813 (Apr. 2, 1997).

Hillier et al., "WashU-Merck EST Project 1997", GenBank Accession No. AA398118 (Apr. 24, 1997).

Hillier et al., "WashU-NCI human EST Project", GenBank Accession No. AA400234 (Dec. 20, 1996).

Hillier et al., "WashU-NCI human EST Project", GenBank Accession No. AA400292 (Dec. 20, 1996).

Hillier et al., "WashU-Merck EST Project 1997", GenBank Accession No. AA400495 (Apr. 28, 1997).

Hillier et al., "WashU-NCI human EST Project", GenBank Accession No. AA401404 (Dec. 20, 1996).

Hillier et al., "WashU-Merck EST Project 1997", GenBank Accession No. AA424574 (May 15, 1997).

Hillier et al., "WashU-Merck EST Project 1997", GenBank Accession No. AA424950 (May 19, 1997).

Hillier et al., "WashU-Merck EST Project 1997", GenBank Accession No. AA426264 (May 19, 1997).

Hillier et al., "WashU-Merck EST Project 1997", GenBank Accession No. AA426561 (May 19, 1997).

Hillier et al., "WashU-Merck EST Project 1997", GenBank Accession No. AA427491 (May 20, 1997).

Hillier et al., "WashU-Merck EST Project 1997", GenBank Accession No. AA427924 (May 20, 1997).

Hillier et al., "WashU-Merck EST Project 1997", GenBank Accession No. AA431741 (May 22, 1997).

Hillier et al., "WashU-Merck EST Project 1997", GenBank Accession No. AA431753 (May 22, 1997).

Hillier et al., "WashU-Merck EST Project 1997", GenBank Accession No. AA436138 (May 30, 1997).

Hillier et al., "WashU-Merck EST Project 1997", GenBank Accession No. AA449490 (Jun. 4, 1997).

Hillier et al., "WashU-Merck EST Project 1997", GenBank Accession No. AA451750 (Jun. 5, 1997).

Hillier et al., "WashU-Merck EST Project 1997", GenBank Accession No. AA453997 (Jun. 5, 1997).

Hillier et al., "WashU-Merck EST Project 1997", GenBank Accession No. AA454632 (Jun. 6, 1997).

Hillier et al., "WashU-Merck EST Project 1997", GenBank Accession No. AA454702 (Jun. 6, 1997).

Hillier et al., "WashU-Merck EST Project 1997", GenBank Accession No. AA454990 (Jun. 6, 1997).

Hillier et al., "WashU-Merck EST Project 1997", GenBank Accession No. AA455911 (Jun. 6, 1997).

Hillier et al., "WashU-Merck EST Project 1997", GenBank Accession No. AA457267 (Jun. 6, 1997).

Hillier et al., "WashU-Merck EST Project 1997", GenBank Accession No. AA458779 (May 29, 1997).

Hillier et al., "WashU-Merck EST Project 1997", GenBank Accession No. AA460282 (Jun. 9, 1997).

Hillier et al., "WashU-Merck EST Project 1997", GenBank Accession No. AA460685 (Jun. 9, 1997).

Hillier et al., "WashU-Merck EST Project 1997", GenBank Accession No. AA461473 (Jun. 9, 1997).

Hillier et al., "WashU-Merck EST Project 1997", GenBank Accession No. AA464180 (Jun. 10, 1997).

Hillier et al., "WashU-Merck EST Project 1997", GenBank Accession No. AA464600 (Jun. 10, 1997).
Hillier et al., "WashU-Merck EST Project 1997", GenBank Accession No. AA464729 (Jun. 10, 1997).
Hillier et al., "WashU-Merck EST Project 1997", GenBank Accession No. AA476257 (Jun. 19, 1997).
Hillier et al., "WashU-Merck EST Project 1997", GenBank Accession No. AA476300 (Jun. 19, 1997).
Hillier et al., "WashU-Merck EST Project 1997", GenBank Accession No. AA476576 (Jun. 19, 1997).
Hillier et al., "WashU-Merck EST Project 1997", GenBank Accession No. AA479102 (Jun. 19, 1997).
Hillier et al., "WashU-Merck EST Project 1997", GenBank Accession No. AA479967 (Jun. 19, 1997).
NCI-CGAP, "National Cancer Institute, Cancer Genome Anatomy Project (CGAP), Tumor Gene Index", GenBank Accession No. 481076 (Jun. 23, 1997).
Hillier et al., "WashU-NCI human EST Project", GenBank Accession No. AA486362 (May 29, 1997).
Hillier et al., "WashU-Merck EST Project 1997", GenBank Accession No. AA490279 (Jun. 25, 1997).
NCI-CGAP, "National Cancer Institute, Cancer Genome Anatomy Project (CGAP), Tumor Gene Index", GenBank Accession No. AA490967 (Jun. 25, 1997).
Hillier et al., "WashU-Merck EST Project 1997", GenBank Accession No. AA496047 (Jun. 30, 1997).
Hillier et al., "WashU-NCI human EST Project", GenBank Accession No. AA598653 (Jun. 24, 1997).
Hillier et al., "WashU-NCI human EST Project", GenBank Accession No. AA620455 (Sep. 30, 1997).
Hillier et al., "WashU-NCI human EST Project", GenBank Accession No. AA621201 (Oct. 14, 1997).
Hillier et al., "WashU-NCI human EST Project", GenBank Accession No. AA629901 (Jun. 24, 1997).
Hillier et al., "WashU-NCI human EST Project", GenBank Accession No. AA553726 (Nov. 12, 1997).
Hillier et al., "WashU-NCI human EST Project", GenBank Accession No. AA664081 (Nov. 12, 1997).
Hillier et al., "WashU-NCI human EST Project", GenBank Accession No. AA664101 (Nov. 12, 1997).
Hillier et al., "WashU-NCI human EST Project", GenBank Accession No. AA664195 (Nov. 12, 1997).
Hillier et al., "WashU-NCI human EST Project", GenBank Accession No. AA668470 (Nov. 20, 1997).
Hillier et al., "WashU-NCI human EST Project", GenBank Accession No. AA676876 (Dec. 2, 1997).
Hillier et al., "WashU-NCI human EST Project", GenBank Accession No. AA677149 (Apr. 4, 1996).
Hillier et al., "WashU-NCI human EST Project", GenBank Accession No. AA677643 (Dec. 2, 1997).
Hillier et al., "WashU-NCI human EST Project", GenBank Accession No. AA678971 (Apr. 4, 1996).
Hillier et al., "WashU-NCI human EST Project", GenBank Accession No. AA699493 (Dec. 19, 1997).
Hillier et al., "WashU-NCI human EST Project", GenBank Accession No. AA700815 (Dec. 19, 1997).
Hillier et al., "WashU-NCI human EST Project", GenBank Accession No. AA703077 (Dec. 19, 1997).
Hillier et al., "WashU-NCI human EST Project", GenBank Accession No. AA703652 (Dec. 24, 1997).
Hillier et al., "WashU-NCI human EST Project", GenBank Accession No. AA705316 (Dec. 24, 1997).
Hillier et al., "WashU-NCI human EST Project", GenBank Accession No. AA705735 (Dec. 24, 1997).
Hillier et al., "WashU-NCI human EST Project", GenBank Accession No. AA706038 (Dec. 24, 1997).
Hillier et al., "WashU-NCI human EST Project", GenBank Accession No. AA707167 (Dec. 24, 1997).
NCI-CGAP, "National Cancer Institute, Cancer Genome Anatomy Project (CGAP), Tumor Gene Index", GenBank Accession No. AA719150 (Dec. 24, 1997).
Hillier et al., "WashU-NCI human EST Project", GenBank Accession No. AA772803 (Jan. 29, 1998).
Hillier et al., "WashU-NCI human EST Project", GenBank Accession No. AA772904 (Jan. 29, 1998).
Hillier et al., "WashU-NCI human EST Project", GenBank Accession No. AA775372 (Feb. 5, 1998).
Hillier et al., "WashU-NCI human EST Project", GenBank Accession No. AA775521 (Feb. 5, 1998).
Hillier et al., "WashU-NCI human EST Project", GenBank Accession No. AA777001 (Feb. 5, 1998).
Hillier et al., "WashU-NCI human EST Project", GenBank Accession No. AA778985 (Feb. 5, 1998).
Hillier et al., "WashU-NCI human EST Project", GenBank Accession No. AA779892 (Feb. 5, 1998).
NCI-CGAP, "National Cancer Institute, Cancer Genome Anatomy Project (CGAP), Tumor Gene Index", GenBank Accession No. AA865362 (Apr. 21, 1998).
NCI-CGAP, "National Cancer Institute, Cancer Genome Anatomy Project (CGAP), Tumor Gene Index", GenBank Accession No. AA865464 (Apr. 21, 1998).
NCI-CGAP, "National Cancer Institute, Cancer Genome Anatomy Project (CGAP), Tumor Gene Index", GenBank Accession No. AA866153 (Feb. 20, 1998).
NCI-CGAP, "National Cancer Institute, Cancer Genome Anatomy Project (CGAP), Tumor Gene Index", GenBank Accession No. AA877815 (Mar. 25, 1998).
NCI-CGAP, "National Cancer Institute, Cancer Genome Anatomy Project (CGAP), Tumor Gene Index", GenBank Accession No. AA887204 (Mar. 30, 1998).
NCI-CGAP, "National Cancer Institute, Cancer Genome Anatomy Project (CGAP), Tumor Gene Index", GenBank Accession No. AA890136 (Apr. 2, 1998).
NCI-CGAP, "National Cancer Institute, Cancer Genome Anatomy Project (CGAP), Tumor Gene Index", GenBank Accession No. AA903339 (Apr. 8, 1998).
NCI-CGAP, "National Cancer Institute, Cancer Genome Anatomy Project (CGAP), Tumor Gene Index", GenBank Accession No. AA903531 (Apr. 8, 1998).
NCI-CGAP, "National Cancer Institute, Cancer Genome Anatomy Project (CGAP), Tumor Gene Index", GenBank Accession No. AA907347 (Mar. 30, 1998).
NCI-CGAP, "National Cancer Institute, Cancer Genome Anatomy Project (CGAP), Tumor Gene Index", GenBank Accession No. AA908678 (Apr. 8, 1998).
NCI-CGAP, "National Cancer Institute, Cancer Genuine Anatomy Project (CGAP), Tumor Gene Index", GenBank Accession No. AA908902 (Apr. 13, 1998).
NCI-CGAP, "National Cancer Institute, Cancer Genome Anatomy Project (CGAP), Tumor Gene Index", GenBank Accession No. AA910828 (Apr. 8, 1998).
NCI-CGAP, "National Cancer Institute, Cancer Genome Anatomy Project (CGAP), Tumor Gene Index", GenBank Accession No. AA913480 (Apr. 14, 1998).
NCI-CGAP, "National Cancer Institute, Cancer Genome Anatomy Project (CGAP), Tumor Gene Index", GenBank Accession No. AA916325 (Apr. 13, 1998).
NCI-CGAP, "National Cancer Institute, Cancer Genome Anatomy Project (CGAP), Tumor Gene Index", GenBank Accession No. AA918535 (Apr. 13, 1998).
NCI-CGAP, "National Cancer Institute, Cancer Genome Anatomy Project (CGAP), Tumor Gene Index", GenBank Accession No. AA927036 (May 20, 1998).
NCI-CGAP, "National Cancer Institute, Cancer Genome Anatomy Project (CGAP), Tumor Gene Index", GenBank Accession No. AA928113 (Apr. 17, 1998).
NCI-CGAP, "National Cancer Institute, Cancer Genome Anatomy Project (CGAP), Tumor Gene Index", GenBank Accession No. AA928660 (Apr. 22, 1998).
NCI-CGAP, "National Cancer Institute, Cancer Genome Anatomy Project (CGAP), Tumor Gene Index", GenBank Accession No. AA931491 (Apr. 24, 1998).
NCI-CGAP, "National Cancer Institute, Cancer Genome Anatomy Project (CGAP), Tumor Gene Index", GenBank Accession No. AA033962 (Apr. 9, 1998).

NCI-CGAP, "National Cancer Institute, Cancer Genome Anatomy Project (CGAP), Tumor Gene Index", GenBank Accession No. AA935694 (Apr. 28, 1998).
NCI-CGAP, "National Cancer Institute, Cancer Genome Anatomy Project (CGAP), Tumor Gene Index", GenBank Accession No. AA936779 (Apr. 13, 1998).
NCI-CGAP, "National Cancer Institute, Cancer Genome Anatomy Project (CGAP), Tumor Gene Index", GenBank Accession No. AA938345 (Apr. 30, 1998).
NCI-CGAP, "National Cancer Institute, Cancer Genome Anatomy Project (CGAP), Tumor Gene Index", GenBank Accession No. AA948041 (Feb. 20, 1998).
NCI-CGAP, "National Cancer Institute, Cancer Genome Anatomy Project (CGAP), Tumor Gene Index", GenBank Accession No. AA962159 (May 15, 1998).
NCI-CGAP, "National Cancer Institute, Cancer Genome Anatomy Project (CGAP), Tumor Gene Index", GenBank Accession No. AA971518 (May 20, 1998).
NCI-CGAP, "National Cancer Institute, Cancer Genome Anatomy Project (CGAP), Tumor Gene Index", GenBank Accession No. AA972020 (May 20, 1998).
NCI-CGAP, "National Cancer Institute, Cancer Genome Anatomy Project (CGAP), Tumor Gene Index", GenBank Accession No. AA972401 (May 20, 1998).
NCI-CGAP, "National Cancer Institute, Cancer Genome Anatomy Project (CGAP), Tumor Gene Index", GenBank Accession No. AA973808 (May 20, 1998).
NCI-CGAP, "National Cancer Institute, Cancer Genome Anatomy Project (CGAP), Tumor Gene Index", GenBank Accession No. AA975538 (May 20, 1998).
NCI-CGAP, "National Cancer Institute, Cancer Genome Anatomy Project (CGAP), Tumor Gene Index", GenBank Accession No. AA976650 (May 26, 1998).
NCI-CGAP, "National Cancer Institute, Cancer Genome Anatomy Project (CGAP), Tumor Gene Index", GenBank Accession No. AA976699 (May 26, 1998).
NCI-CGAP, "National Cancer Institute, Cancer Genome Anatomy Project (CGAP), Tumor Gene Index", GenBank Accession No. AA992658 (Jun. 3, 1998).
NCI-CGAP, "National Cancer Institute, Cancer Genome Anatomy Project (CGAP), Tumor Gene Index", GenBank Accession No. AA994097 (Jun. 10, 1998).
Seki et al., "Characterization of cDNA clones in size-fractionated cDNA libraries from human brain", GenBank Accession No. AB007954 (Aug. 13, 1997).
Ishikawa et al., "Prediction of the coding sequences of unidentified human genes. X. The complete sequences of 100 new cDNA clones from brain which can code for large proteins in vitro", GenBank Accession No. AB014544 (Jan. 10, 2004).
Nagase et al., "Prediction of the coding sequences of unidentified human genes. XVI. The complete sequences of 150 new cDNA clones from brain which code for large proteins in vitro", GenBank Accession No. AB037805 (Mar. 14, 2000).
Guru et al., "A transcript map for the 2.8-Mb region containing the multiple endocrine neoplasia type 1 locus", GenBank Accession No. AF001893 (Oct. 16, 1997).
Anderson et al., "A 'double adaptor' method for improved shotgun library construction", GenBank Accession No. AF131795 (Mar. 12, 1999).
Persson et al., "EU-IMAGE: Full-insert length sequencing of human cDNA clones", GenBank Accession No. AF146695 (May 25, 1999).
NCI-CGAP, "National Cancer Institute, Cancer Genome Anatomy Project (CGAP), Tumor Gene Index", GenBank Accession No. AI000557 (Jun. 5, 1998).
NCI-CGAP, "National Cancer Institute, Cancer Genome Anatomy Project (CGAP), Tumor Gene Index", GenBank Accession No. AI005515 (Jun. 18, 1998).
NCI-CGAP, "National Cancer Institute, Cancer Genome Anatomy Project (CGAP), Tumor Gene Index", GenBank Accession No. AI018400 (Aug. 13, 1998).
NCI-CGAP, "National Cancer Institute, Cancer Genome Anatomy Project (CGAP), Tumor Gene Index", GenBank Accession No. AI028034 (Jun. 22, 1998).
NCI-CGAP, "National Cancer Institute, Cancer Genome Anatomy Project (CGAP), Tumor Gene Index", GenBank Accession No. AI051108 (Jun. 25, 1998).
NCI-CGAP, "National Cancer Institute, Cancer Genome Anatomy Project (CGAP), Tumor Gene Index", GenBank Accession No. AI055991 (Jun. 25, 1998).
NCI-CGAP, "National Cancer Institute, Cancer Genome Anatomy Project (CGAP), Tumor Gene Index", GenBank Accession No. AI088327 (Aug. 18, 1998).
NCI-CGAP, "National Cancer Institute, Cancer Genome Anatomy Project (CGAP), Tumor Gene Index", GenBank Accession No. AI129115 (Sep. 10, 1998).
NCI-CGAP, "National Cancer Institute, Cancer Genome Anatomy Project (CGAP), Tumor Gene Index", GenBank Accession No. AI143189 (Sep. 28, 1998).
NCI/NINDS-CGAP, "National Cancer Institute/National Institute of Neurological Disorders and Stroke, Brain Tumor Genome Anatomy Project (CGAP/BTGAP), Tumor Gene Index", GenBank Accession No. AI159901 (Oct. 2, 1998).
Hillier et al., "WashU-NCI human EST Project", GenBank Accession No. AI174481 (Oct. 7, 1998).
NCI-CGAP, "National Cancer Institute, Cancer Genome Anatomy Project (CGAP), Tumor Gene Index", GenBank Accession No. AI205664 (Oct. 16, 1998).
NCI-CGAP, "National Cancer Institute, Cancer Genome Anatomy Project (CGAP), Tumor Gene Index", GenBank Accession No. AI240426 (Nov. 4, 1998).
NCI-CGAP, "National Cancer Institute, Cancer Genome Anatomy Project (CGAP), Tumor Gene Index", GenBank Accession No. AI245607 (Nov. 4, 1998).
NCI-CGAP, "National Cancer Institute, Cancer Genome Anatomy Project (CGAP), Tumor Gene Index", GenBank Accession No. AI248323 (Nov. 4, 1998).
NCI-CGAP, "National Cancer Institute, Cancer Genome Anatomy Project (CGAP), Tumor Gene Index", GenBank Accession No. AI268241 (Nov. 17, 1998).
NCI-CGAP, "National Cancer Institute, Cancer Genome Anatomy Project (CGAP), Tumor Gene Index", GenBank Accession No. AI268450 (Nov. 17, 1998).
NCI-CGAP, "National Cancer Institute, Cancer Genome Anatomy Project (CGAP), Tumor Gene Index", GenBank Accession No. AI269361 (Nov. 17, 1998).
NCI-CGAP, "National Cancer Institute, Cancer Genome Anatomy Project (CGAP), Tumor Gene Index", GenBank Accession No. AI277247 (Nov. 20, 1998).
NCI-CGAP, "National Cancer Institute, Cancer Genome Anatomy Project (CGAP), Tumor Gene Index", GenBank Accession No. AI278518 (Nov. 20, 1998).
NCI-CGAP, "National Cancer Institute, Cancer Genome Anatomy Project (CGAP), Tumor Gene Index", GenBank Accession No. AI290481 (Nov. 30, 1998).
NCI-CGAP, "National Cancer Institute, Cancer Genome Anatomy Project (CGAP), Tumor Gene Index", GenBank Accession No. AI300926 (Dec. 3, 1998).
NCI-CGAP, "National Cancer Institute, Cancer Genome Anatomy Project (CGAP), Tumor Gene Index", GenBank Accession No. AI306467 (Dec. 9, 1998).
NCI-CGAP, "National Cancer Institute, Cancer Genome Anatomy Project (CGAP), Tumor Gene Index", GenBank Accession No. AI308916 (Dec. 11, 1998).
NCI-CGAP, "National Cancer Institute, Cancer Genome Anatomy Project (CGAP), Tumor Gene Index", GenBank Accession No. AI333640 (Dec. 28, 1998).
NCI/NINDS-CGAP, "National Cancer Institute/National Institute of Neurological Disorders and Stroke, Brain Tumor Genome Anatomy Project (CGAP/BTGAP), Tumor Gene Index", GenBank Accession No. AI356230 (Jan. 6, 1999).
NCI-CGAP, "National Cancer Institute, Cancer Genome Anatomy Project (CGAP), Tumor Gene Index", GenBank Accession No. AI368364 (Jan. 11, 1999).
NCI-CGAP, "National Cancer Institute, Cancer Genome Anatomy Project (CGAP), Tumor Gene Index", GenBank Accession No. AI391632 (Feb. 2, 1999).

NCI-CGAP, "National Cancer Institute, Cancer Genome Anatomy Project (CGAP), Tumor Gene Index", GenBank Accession No. AI433655 (Feb. 12, 1999).
NCI/NINDS-CGAP, "National Cancer Institute/National Institute of Neurological Disorders and Stroke, Brain Tumor Genome Anatomy Project (CGAP/BTGAP), Tumor Gene Index", GenBank Accession No. AI493478 (Mar. 11, 1999).
NCI-CGAP, "National Cancer Institute, Cancer Genome Anatomy Project (CGAP), Tumor Gene Index", GenBank Accession No. AI539460 (Mar. 18, 1999).
NCI-CGAP, "National Cancer Institute, Cancer Genome Anatomy Project (CGAP), Tumor Gene Index", GenBank Accession No. AI623173 (Apr. 22, 1999).
NCI-CGAP, "National Cancer Institute, Cancer Genome Anatomy Project (CGAP), Tumor Gene Index", GenBank Accession No. AI630806 (Apr. 26, 1999).
NCI-CGAP, "National Cancer Institute, Cancer Genome Anatomy Project (CGAP), Tumor Gene Index", GenBank Accession No. AI685539 (May 27, 1999).
NCI-CGAP, "National Cancer Institute, Cancer Genome Anatomy Project (CGAP), Tumor Gene Index", GenBank Accession No. AI692753 (Jun. 2, 1999).
NCI-CGAP, "National Cancer Institute, Cancer Genome Anatomy Project (CGAP), Tumor Gene Index", GenBank Accession No. AI693344 (Jun. 2, 1999).
NCI-CGAP, "National Cancer Institute, Cancer Genome Anatomy Project (CGAP), Tumor Gene Index", GenBank Accession No. AI762428 (Jun. 24, 1999).
NCI-CGAP, "National Cancer Institute, Cancer Genome Anatomy Project (CGAP), Tumor Gene Index", GenBank Accession No. AI807646 (Jul. 7, 1999).
NCI-CGAP, "National Cancer Institute, Cancer Genome Anatomy Project (CGAP), Tumor Gene Index", GenBank Accession No. AI810168 (Jul. 7, 1999).
NCI-CGAP, "National Cancer Institute, Cancer Genome Anatomy Project (CGAP), Tumor Gene Index", GenBank Accession No. AI826477 (Jul. 12, 1999).
NCI-CGAP, "National Cancer Institute, Cancer Genome Anatomy Project (CGAP), Tumor Gene Index", GenBank Accession No. AI830281 (Jul. 12, 1999).
NCI-CGAP, "National Cancer Institute, Cancer Genome Anatomy Project (CGAP), Tumor Gene Index", GenBank Accession No. AI924357 (Jul. 30, 1999).
NCI-CGAP, "National Cancer Institute, Cancer Genome Anatomy Project (CGAP), Tumor Gene Index", GenBank Accession No. AI961087 (Aug. 20, 1999).
Ota et al., "NEDO human cDNA sequencing project", GenBank Accession No. AK001013 (Sep. 12, 2006).
Ota et al., "NEDO human cDNA sequencing project", GenBank Accession No. AK021785 (Sep. 12, 2006).
Ota et al., "NEDO human cDNA sequencing project", GenBank Accession No. AK055280 (Sep. 13, 2006).
Ota et al., "NEDO human cDNA sequencing project", GenBank Accession No. AK092129 (Sep. 14, 2006).
Ota et al., "NEDO human cDNA sequencing project", GenBank Accession No. AK092836 (Sep. 14, 2006).
Ota et al., "NEDO human cDNA sequencing project", GenBank Accession No. AK092951 (Sep. 14, 2006).
Ota et al., "NEDO human cDNA sequencing project", GenBank Accession No. AK123640 (Sep. 14, 2006).
Ota et al., "NEDO human cDNA sequencing project", GenBank Accession No. AK124396 (Sep. 14, 2006).
Ota et al., "NEDO human cDNA sequencing project", GenBank Accession No. AK125162 (Sep. 14, 2006).
Oshima et al., "NEDO human cDNA sequencing prlject", GenBank Accession No. AK128524 (Sep. 14, 2006).
Bahr et al., "Direct Submission", GenBank Accession No. AL049227 (Sep. 22, 1004).
Li et al., "Full-length cDNA libraries and normalization", GenBank Accession No. AL519577 (Feb. 13, 2001).
Wambutt et al., "Direct Submission", GenBank Accession No. AL832194 (May 13, 2003).
Ansorge et al., "Direct Submission", GenBank Accession No. AL832666 (May 13, 2003).
Bahr et al., "Direct Submission", GenBank Accession No. AL833547 (May 13, 2003).
Ohira et al., "Expression profiling and characterization of 4200 genes cloned from primary neuroblastomas: identification of 305 genes differentially expressed between favorable and unfavorable subsets", GenBank Accession No. AU253973 (Aug. 27, 2003).
Hillier et al., "WashU-NCI human EST Project", GenBank Accession No. AW157797 (Nov. 4, 1999).
NCI-CGAP, "National Cancer Institute, Cancer Genome Anatomy Project (CGAP), Tumor Gene Index", GenBank Accession No. AW510753 (Mar. 3, 2000).
Strausberg, "Direct Submission", GenBank Accession No. BC004287 (Jul. 17, 2001).
Strausberg, "Direct Submission", GenBank Accession No. BC012900 (Aug. 22, 2001).
Strausberg et al., "Generation and initial analysis of more than 15,000 full-length human and mouse cDNA sequences", GenBank Accession No. BC030554 (Dec. 2, 2006).
Strausberg et al., "Direct Submission", GenBank Accession No. BC035185 (Dec. 12, 2006).
Strausberg et al., "Direct Submission", GenBank Accession No. BC040073 (Dec. 11, 2003).
Strausberg, "Direct Submission", GenBank Accession No. BC041074 (Mar. 4, 2003).
Strausberg et al., "Generation and initial analysis of more than 15,000 full-length human and mouse cDNA sequences", GenBank Accession No. BC042456 (Jul. 21, 2005).
Strausberg et al., "Generation and initial analysis of more than 15,000 full-length human and mouse cDNA sequences", GenBank Accession No. BC043430 (Jul. 21, 2005).
NIH-MGC, "National Institutes of Health, Mammalian Gene Collection", GenBank Accession No. BE970051 (Oct. 3, 2000).
NIH-MGC, "National Institutes of Health, Mammalian Gene Collection", GenBank Accession No. BG576442 (Apr. 9, 2001).
Bonaldo et al., "Normalization and subtraction: two approaches to facilitate gene discovery", GenBank Accession No. BM701300 (Feb. 28, 2002).
Bonaldo et al., "Normalization and subtraction: two approaches to facilitate gene discovery", GenBank Accession No. BM716109 (Feb. 28, 2002).
Bonaldo et al., "Normalization and subtraction: two approaches to facilitate gene discovery", GenBank Accession No. BM721099 (Mar. 1, 2002).
NCI-CGAP, "National Cancer Institute, Cancer Genome Anatomy Project (CGAP), Tumor Gene Index", GenBank Accession No. BQ012257 (Mar. 26, 2002).
NCI-CGAP, "National Cancer Institute, Cancer Genome Anatomy Project (CGAP), Tumor Gene Index", GenBank Accession No. BU620794 (Sep. 23, 2002).
Ebert et al., "Human UnigeneSet—RZPD3", GenBank Accession No. BX093245 (Jan. 22, 2003).
Ebert et al., "Human UnigeneSet—RZPD3", GenBank Accession No. BX100412 (Jan. 22, 2003).
Ebert et al., "Human UnigeneSet—RZPD3", GenBank Accession No. BX101784 (Jan. 22, 2003).
Ebert et al., "Human UnigeneSet—RZPD3", GenBank Accession No. BX105296 (Jan. 22, 2003).
Ebert et al., "Human UnigeneSet—RZPD3", GenBank Accession No. BX107971 (Jan. 22, 2003).
Li et al., "Full-length cDNA libraries and normalization", GenBank Accession No. BX365439 (May 5, 2003).
Lauber et al., "Direct Submission", GenBank Accession No. BX538341 (Jun. 17, 2003).
Bloecker et al., "Direct Submission", GenBank Accession No. BX648323 (Feb. 23, 2005).
Lauber et al., "Direct Submission", GenBank Accession No. BX648828 (Aug. 30, 2003).
Lauber et al., "Direct Submission", GenBank Accession No. BX648964 (Aug. 30, 2003).
Hillier et al., "The WashU-Merck EST Project", GenBank Accession No. H05706 (Jun. 21, 1995).

Hillier et al., "The WashU-Merck EST Project", GenBank Accession No. H08643 (Jun. 23, 1995).
Hillier et al., "The WashU-Merck EST Project", GenBank Accession No. H10403 (Jun. 23, 1995).
Hillier et al., "The WashU-Merck EST Project", GenBank Accession No. H13691 (Jun. 27, 1995).
Hillier et al., "The WashU-Merck EST Project", GenBank Accession No. H20717 (Jul. 3, 1995).
Hillier et al., "The WashU-Merck EST Project", GenBank Accession No. H23444 (Jul. 6, 1995).
Hillier et al., "The WashU-Merck EST Project", GenBank Accession No. H23463 (Jul. 6, 1995).
Hillier et al., "The WashU-Merck EST Project", GenBank Accession No. H28091 (Jul. 13, 1995).
Hillier et al., "The WashU-Merck EST Project", GenBank Accession No. H40323 (Jul. 31, 1995).
Hillier et al., "The WashU-Merck EST Project", GenBank Accession No. H40665 (Jul. 31, 1995).
Hillier et al., "The WashU-Merck EST Project", GenBank Accession No. H51419 (Sep. 18, 1995).
Hillier et al., "Generation and analysis of 280,000 human expressed sequence tags", GenBank Accession No. H65066 (Oct. 18, 1995).
Hillier et al., "Generation and analysis of 280,000 human expressed sequence tags", GenBank Accession No. H77627 (Nov. 9, 1995).
Hillier et al., "The WashU-Merck EST Project", GenBank Accession No. H86117 (Nov. 21, 1995).
Hillier et al., "The WashU-Merck EST Project", GenBank Accession No. H90431 (Nov. 28, 1995).
Hillier et al., "The WashU-Merck EST Project", GenBank Accession No. H90890 (Nov. 28, 1995).
Hillier et al., "The WashU-Merck EST Project", GenBank Accession No. H92875 (Nov. 30, 1995).
Hillier et al., "The WashU-Merck EST Project", GenBank Accession No. H98855 (Dec. 15, 1995).
Hillier et al., "The WashU-Merck EST Project", GenBank Accession No. N20796 (Dec. 19, 1995).
Hillier et al., "The WashU-Merck EST Project", GenBank Accession No. N20820 (Dec. 19, 1995).
Hillier et al., "Generation and analysis of 280,000 human expressed sequence tags", GenBank Accession No. N22620 (Dec. 20, 1995).
Hillier et al., "The WashU-Merck EST Project", GenBank Accession No. N24966 (Dec. 28, 1995).
Hillier et al., "The WashU-Merck EST Project", GenBank Accession No. N32904 (Jan. 10, 1996).
Hillier et al., "The WashU-Merck EST Project", GenBank Accession No. N41052 (Jan. 22, 1996).
Hillier et al., "The WashU-Merck EST Project", GenBank Accession No. N47979 (Feb. 14, 1996).
Hillier et al., "The WashU-Merck EST Project", GenBank Accession No. N50114 (Feb. 14, 1996).
Hillier et al., "The WashU-Merck EST Project", GenBank Accession No. N50742 (Feb. 14, 1996).
Hillier et al., "The WashU-Merck EST Project", GenBank Accession No. N50880 (Feb. 14, 1996).
Hillier et al., "The WashU-Merck EST Project", GenBank Accession No. N51614 (Feb. 14, 1996).
Hillier et al., "The WashU-Merck EST Project", GenBank Accession No. N51740 (Feb. 15, 1996).
Hillier et al., "The WashU-Merck EST Project", GenBank Accession No. N52151 (Feb. 15, 1996).
Hillier et al., "Generation and analysis of 280,000 human expressed sequence tags", GenBank Accession No. N52812 (Feb. 15, 1996).
Hillier et al., "The WashU-Merck EST Project", GenBank Accession No. N55540 (Feb. 20, 1996).
Hillier et al., "Generation and analysis of 280,000 human expressed sequence tags", GenBank Accession No. N58494 (Feb. 15, 1996).
Hillier et al., "Generation and analysis of 280,000 human expressed sequence tags", GenBank Accession No. N59441 (Feb. 23, 1996).
Hillier et al., "The WashU-Merck EST Project", GenBank Accession No. N63057 (Mar. 1, 1996).
Hillier et al., "The WashU-Merck EST Project", GenBank Accession No. N66644 (Mar. 8, 1996).
Hillier et al., "The WashU-Merck EST Project", GenBank Accession No. N74203 (Mar. 19, 1996).
Hillier et al., "The WashU-Merck EST Project", GenBank Accession No. N75004 (Mar. 29, 1996).
Hillier et al., "Generation and analysis of 280,000 human expressed sequence tags", GenBank Accession No. N91921 (May 9, 1996).
Hillier et al., "The WashU-Merck EST Project", GenBank Accession No. N93122 (Apr. 5, 1996).
GenBank Accession No. NM_000024 (Aug. 12, 2007).
GenBank Accession No. NM_000079 (Jun. 27, 2007).
GenBank Accession No. NM_000147 (Jun. 26, 2007).
GenBank Accession No. NM_000189 (Jun. 26, 2007).
GenBank Accession No. NM_000191 (Jul. 29, 2007).
GenBank Accession No. NM_000304 (Jan. 21, 2007).
GenBank Accession No. NM_000517 (Aug. 12, 2007).
GenBank Accession No. NM_000610 (Aug. 20, 2007).
GenBank Accession No. NM_000689 (Aug. 20, 2007).
GenBank Accession No. NM_000878 (Jun. 3, 2007).
GenBank Accession No. NM_000880 (Jun. 26, 2007).
GenBank Accession No. NM_000900 (Jul. 30, 2007).
GenBank Accession No. NM_001035 (Aug. 10, 2007).
GenBank Accession No. NM_001103 (Feb. 4, 2007).
GenBank Accession No. NM_001117 (Jul. 30, 2007).
GenBank Accession No. NM_001168 (Aug. 12, 2007).
GenBank Accession No. NM_001275 (Aug. 6, 2007).
GenBank Accession No. NM_001353 (Jun. 27, 2007).
GenBank Accession No. NM_001354 (Jun. 26, 2007).
GenBank Accession No. NM_001474 (Jun. 3, 2007).
GenBank Accession No. NM_001684 (Jun. 26, 2007).
GenBank Accession No. NM_001719 (Jul. 10, 2007).
GenBank Accession No. NM_001778 (Jun. 27, 2007).
GenBank Accession No. NM_001796 (Nov. 17, 2006).
GenBank Accession No. NM_001803 (Jun. 26, 2007).
GenBank Accession No. NM_001827 (Jun. 3, 2007).
GenBank Accession No. NM_001852 (Jun. 26, 2007).
GenBank Accession No. NM_001940 (Jun. 27, 2007).
GenBank Accession No. NM_002048 (Nov. 17, 2006).
GenBank Accession No. NM_002118 (Jun. 3, 2007).
GenBank Accession No. NM_002122 (Aug. 20, 2007).
GenBank Accession No. NM_002124 (Aug. 20, 2007).
GenBank Accession No. NM_002163 (Aug. 5, 2007).
GenBank Accession No. NM_002298 (Jun. 27, 2007).
GenBank Accession No. NM_002346 (Nov. 17, 2006).
GenBank Accession No. NM_002351 (Aug. 20, 2007).
GenBank Accession No. NM_002358 (Jun. 26, 2007).
GenBank Accession No. NM_002375 (Jun. 26, 2007).
GenBank Accession No. NM_002417 (Jul. 30, 2007).
GenBank Accession No. NM_002426 (Jul. 31, 2007).
GenBank Accession No. NM_002467 (Aug. 12, 2007).
GenBank Accession No. NM_002585 (Jun. 27, 2007).
GenBank Accession No. NM_002738 (Jun. 26, 2007).
GenBank Accession No. NM_002771 (Jul. 29, 2007).
GenBank Accession No. NM_002839 (Aug. 6, 2007).
GenBank Accession No. NM_002867 (Jun. 3, 2007).
GenBank Accession No. NM_002976 (Jul. 29, 2007).
GenBank Accession No. NM_003062 (Dec. 17, 2006).
GenBank Accession No. NM_003385 (Jun. 26, 2007).
GenBank Accession No. NM_003459 (Jun. 26, 2007).
GenBank Accession No. NM_003551 (Jun. 26, 2007).
GenBank Accession No. NM_003617 (Aug. 16, 2007).
GenBank Accession No. NM_003619 (Nov. 17, 2006).
GenBank Accession No. NM_003739 (Jun. 3, 2007).
GenBank Accession No. NM_003835 (Aug. 16, 2007).
GenBank Accession No. NM_003836 (Jun. 27, 2007).
GenBank Accession No. NM_003914 (Jun. 3, 2007).
GenBank Accession No. NM_004114 (May 23, 2007).
GenBank Accession No. NM_004378 (Jun. 3, 2007).
GenBank Accession No. NM_004386 (Jun. 26, 2007).
GenBank Accession No. NM_004540 (Jun. 3, 2007).
GenBank Accession No. NM_004675 (Jun. 27, 2007).
GenBank Accession No. NM_004714 (Mar. 11, 2007).
GenBank Accession No. NM_004801 (Aug. 12, 2007).
GenBank Accession No. NM_004807 (Jul. 1, 2007).

GenBank Accession No. NM_004826 (Jun. 3, 2007).
GenBank Accession No. NM_005225 (Aug. 6, 2007).
GenBank Accession No. NM_005295 (Jun. 26, 2007).
GenBank Accession No. NM_005378 (Jul. 30, 2007).
GenBank Accession No. NM_005520 (Jun. 3, 2007).
GenBank Accession No. NM_005555 (Jun. 27, 2007).
GenBank Accession No. NM_005761 (Jun. 3, 2007).
GenBank Accession No. NM_005864 (Nov. 17, 2006).
GenBank Accession No. NM_005892 (Jul. 29, 2007).
GenBank Accession No. NM_006030 (Jun. 26, 2007).
GenBank Accession No. NM_006040 (Jun. 26, 2007).
GenBank Accession No. NM_006043 (Nov. 17, 2006).
GenBank Accession No. NM_006080 (Aug. 6, 2007).
GenBank Accession No. NM_006108 (Jun. 26, 2007).
GenBank Accession No. NM_006393 (Jun. 3, 2007).
GenBank Accession No. NM_006475 (Jul. 1, 2007).
GenBank Accession No. NM_006726 (Jun. 27, 2007).
GenBank Accession No. NM_007101 (Nov. 17, 2006).
GenBank Accession No. NM_013272 (Jun. 3, 2007).
GenBank Accession No. NM_013282 (Jun. 26, 2007).
GenBank Accession No. NM_014141 (Jul. 30, 2007).
GenBank Accession No. NM_014333 (Aug. 25, 2007).
GenBank Accession No. NM_014501 (Jun. 26, 2007).
GenBank Accession No. NM_014585 (Aug. 6, 2007).
GenBank Accession No. NM_014903 (Jun. 27, 2007).
GenBank Accession No. NM_014936 (Jun. 26, 2007).
GenBank Accession No. NM_014944 (Aug. 16, 2007).
GenBank Accession No. NM_014962 (Jun. 3, 2007).
GenBank Accession No. NM_015193 (Jun. 26, 2007).
GenBank Accession No. NM_015529 (Jun. 26, 2007).
GenBank Accession No. NM_015980 (Jun. 3, 2007).
GenBank Accession No. NM_016083 (Aug. 20, 2007).
GenBank Accession No. NM_016142 (Jul. 25, 2007).
GenBank Accession No. NM_016184 (Aug. 16, 2007).
GenBank Accession No. NM_016300 (Jun. 26, 2007).
GenBank Accession No. NM_016315 (Jun. 27, 2007).
GenBank Accession No. NM_016601 (Jan. 27, 2007).
GenBank Accession No. NM_016941 (Jun. 26, 2007).
GenBank Accession No. NM_018440 (Jun. 26, 2007).
GenBank Accession No. NM_018476 (Jun. 26, 2007).
GenBank Accession No. NM_018492 (Aug. 20, 2007).
GenBank Accession No. NM_018640 (Jun. 26, 2007).
GenBank Accession No. NM_018841 (Jun. 27, 2007).
GenBank Accession No. NM_019029 (Jun. 26, 2007).
GenBank Accession No. NM_019845 (Jun. 26, 2007).
GenBank Accession No. NM_020403 (Jun. 27, 2007).
GenBank Accession No. NM_020455 (Jun. 3, 2007).
GenBank Accession No. NM_020630 (Aug. 12, 2007).
GenBank Accession No. NM_020647 (Jun. 26, 2007).
GenBank Accession No. NM_020680 (Jun. 26, 2007).
GenBank Accession No. NM_021723 (Jun. 3, 2007).
GenBank Accession No. NM_023002 (Jun. 27, 2007).
GenBank Accession No. NM_024629 (Aug. 23, 2007).
GenBank Accession No. NM_024838 (Jul. 27, 2007).
GenBank Accession No. NM_030651 (Jun. 26, 2007).
GenBank Accession No. NM_030906 (Jun. 26, 2007).
GenBank Accession No. NM_031412 (Jun. 27, 2007).
GenBank Accession No. NM_032621 (Jun. 26, 2007).
GenBank Accession No. NM_033495 (Jul. 25, 2007).
GenBank Accession No. NM_033664 (Apr. 23, 2005).
GenBank Accession No. NM_052918 (Jun. 26, 2007).
GenBank Accession No. NM_080831 (Jun. 3, 2007).
GenBank Accession No. NM_133445 (Mar. 25, 2007).
GenBank Accession No. NM_138424 (Aug. 2, 2007).
GenBank Accession No. NM_144702 (Nov. 17, 2006).
GenBank Accession No. NM_144966 (Aug. 4, 2007).
GenBank Accession No. NM_145323 (Dec. 18, 2005).
GenBank Accession No. NM_145728 (Jul. 30, 2007).
GenBank Accession No. NM_145893 (Mar. 11, 2007).
GenBank Accession No. NM_152545 (Feb. 28, 2007).
GenBank Accession No. NM_152765 (Jun. 3, 2007).
GenBank Accession No. NM_172107 (Jun. 27, 2007).
GenBank Accession No. NM_173060 (Jun. 26, 2007).
GenBank Accession No. NM_173509 (Jun. 3, 2007).
GenBank Accession No. NM_176814 (Jun. 26, 2007).
GenBank Accession No. NM_181795 (Jun. 3, 2007).
GenBank Accession No. NM_181847 (Jun. 27, 2007).
GenBank Accession No. NM_199051 (Aug. 25, 2007).
GenBank Accession No. NM_199188 (Jun. 26, 2007).
GenBank Accession No. NM_201266 (Aug. 20, 2007).
Hillier et al., "The WashU-Merck EST Project", GenBank Accession No. R00809 (Mar. 31, 1995).
Hillier et al., "The WashU-Merck EST Project", GenBank Accession No. R13972 (Apr. 12, 1995).
Hillier et al., "The WashU-Merck EST Project", GenBank Accession No. R15791 (Feb. 21, 1995).
Hillier et al., "The WashU-Merck EST Project", GenBank Accession No. R15853 (Feb. 21, 1995).
Hillier et al., "The WashU-Merck EST Project", GenBank Accession No. R20626 (Apr. 18, 1995).
Hillier et al., "The WashU-Merck EST Project", GenBank Accession No. R34343 (May 2, 1995).
Hillier et al., "The WashU-Merck EST Project", GenBank Accession No. R37656 (May 4, 1995).
Hillier et al., "The WashU-Merck EST Project", GenBank Accession No. R41560 (May 8, 1995).
Hillier et al., "The WashU-Merck EST Project", GenBank Accession No. R42630 (May 8, 1995).
Hillier et al., "The WashU-Merck EST Project", GenBank Accession No. R48248 (May 18, 1995).
Hillier et al., "The WashU-Merck EST Project", GenBank Accession No. R49458 (May 18, 1995).
Hillier et al., "The WashU-Merck EST Project", GenBank Accession No. R52543 (May 18, 1995).
Hillier et al., "The WashU-Merck EST Project", GenBank Accession No. R52824 (May 18, 1995).
Hillier et al., "The WashU-Merck EST Project", GenBank Accession No. R53455 (May 18, 1995).
Hillier et al., "The WashU-Merck EST Project", GenBank Accession No. R56219 (May 23, 1995).
Hillier et al., "The WashU-Merck EST Project", GenBank Accession No. R56614 (May 23, 1995).
Hillier et al., "The WashU-Merck EST Project", GenBank Accession No. R60014 (May 24, 1995).
Hillier et al., "The WashU-Merck EST Project", GenBank Accession No. R61128 (May 24, 1995).
Hillier et al., "The WashU-Merck EST Project", GenBank Accession No. R61341 (May 24, 1995).
Hillier et al., "The WashU-Merck EST Project", GenBank Accession No. R61395 (May 24, 1995).
Hillier et al., "The WashU-Merck EST Project", GenBank Accession No. R62835 (May 26, 1995).
Hillier et al., "The WashU-Merck EST Project", GenBank Accession No. R66103 (May 30, 1995).
Hillier et al., "The WashU-Merck EST Project", GenBank Accession No. R68243 (Jun. 1, 1995).
Hillier et al., "The WashU-Merck EST Project", GenBank Accession No. R73759 (Jun. 5, 1995).
Hillier et al., "The WashU-Merck EST Project", GenBank Accession No. R77783 (Jun. 7, 1995).
Hillier et al., "The WashU-Merck EST Project", GenBank Accession No. R91170 (Aug. 25, 1995).
Hillier et al., "The WashU-Merck EST Project", GenBank Accession No. R92994 (Aug. 28, 1995).
Hillier et al., "The WashU-Merck EST Project", GenBank Accession No. R93124 (Aug. 29, 1995).
Hillier et al., "The WashU-Merck EST Project", GenBank Accession No. R98407 (Sep. 13, 1995).
Hillier et al., "Generation and analysis of 280,000 human expressed sequence tags", GenBank Accession No. T52564 (Feb. 6, 1995).
Hillier et al., "Generation and analysis of 280,000 human expressed sequence tags", GenBank Accession No. T60160 (Feb. 9, 1995).
Hillier et al., "The WashU-Merck EST Project", GenBank Accession No. T67053 (Feb. 21, 1995).
Hillier et al., "The WashU-Merck EST Project", GenBank Accession No. T70327 (Feb. 23, 1995).

Hillier et al., "The WashU-Merck EST Project", GenBank Accession No. T70329 (Feb. 23, 1995).
Hillier et al., "The WashU-Merck EST Project", GenBank Accession No. T84084 (Mar. 16, 1995).
Hillier et al., "The WashU-Merck EST Project", GenBank Accession No. T95274 (Mar. 27, 1995).
Hillier et al., "The WashU-Merck EST Project", GenBank Accession No. T96951 (Mar. 27, 1995).
Hillier et al., "The WashU-Merck EST Project", GenBank Accession No. W16836 (Apr. 29, 1996).
Hillier et al., "Generation and analysis of 280,000 human expressed sequence tags", GenBank Accession No. W24873 (May 9, 1996).
Hillier et al., "The WashU-Merck EST Project", GenBank Accession No. W60582 (May 22, 1996).
Hillier et al., "The WashU-Merck EST Project", GenBank Accession No. W63783 (May 22, 1996).
Hillier et al., "The WashU-Merck EST Project", GenBank Accession No. W72068 (Jun. 19, 1996).
Hillier et al., "The WashU-Merck EST Project", GenBank Accession No. W73144 (Jun. 14, 1996).
Hillier et al., "The WashU-Merck EST Project", GenBank Accession No. W81677 (Jun. 19, 1996).
GenBank Accession No. XM_166254 (Mar. 1, 2006).
GenBank Accession No. XM_171054 (Aug. 29, 2006).
GenBank Accession No. XM_371717 (Aug. 29, 2006).
GenBank Accession No. XM_379927 (Aug. 20, 2004).

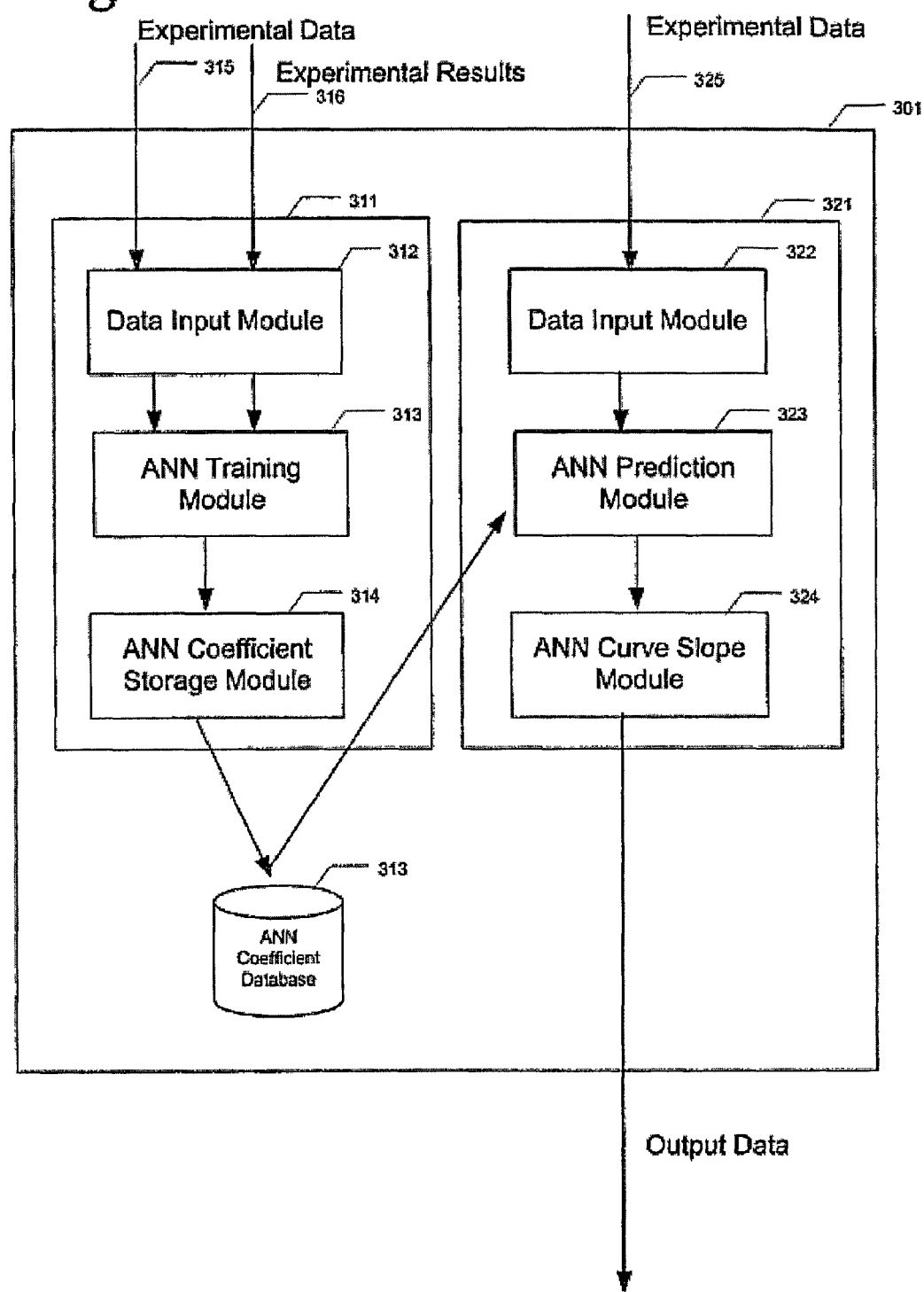

FIG. 8C

Multivariate Cox Model Based on Age, Stage, and MYCN Status

| Variables | Parameter Estimate | WaldP₂ | H.R. | 95% C.I. for H.R. |
|---|---|---|---|---|
| Age (>1yr vs. <1yr) | 1.31 | 0.24 | 3.7 | (0.4-32.0) |
| INSS Stage (Stage 4 vs. Stages 1-3) | 0.79 | 0.31 | 2.2 | (0.5-10.3) |
| MYCN status (amp. vs. not amp.) | 1.64 | 0.0064 | 5.1 | (1.6-16.7) |

FIG. 8D

Multivariate Cox Model Based on MYCN Status and All Clones

| Variables | Parameter Estimate | WaldP₂ | H.R. | 95% C.I. for H.R. |
|---|---|---|---|---|
| MYCN status (amp. vs. not amp.) | 1.06 | 0.054 | 2.9 | (1.0-8.5) |
| All 37920 Clones LOO (Poor vs. Good) | 1.53 | 0.025 | 4.6 | (1.2-17.5) |

PREDICTION OF CLINICAL OUTCOME USING GENE EXPRESSION PROFILING AND ARTIFICIAL NEURAL NETWORKS FOR PATIENTS WITH NEUROBLASTOMA

CROSS REFERENCE TO RELATED APPLICATIONS

This application is a continuation of PCT/US2005/027660, filed Aug. 3, 2005, which claims priority to U.S. Provisional Patent Application Ser. No. 60/598,728, filed Aug. 3, 2004 and claims the benefit of that application under 35 U.S.C. §119(e), which applications are hereby incorporated by reference.

STATEMENT REGARDING FEDERALLY SUPPORTED RESEARCH

This invention was developed with the support of the Department of Health and Human Services. The Government of the United States of America has certain rights in the invention disclosed and claimed herein below.

FIELD OF THE INVENTION

The invention relates generally to selections of genes expressed in a patient with neuroblastoma that function to characterize the neuroblastoma, and methods of using the same for predicting the outcome of and for targeting the therapy of neuroblastoma. The invention also relates generally to the use of supervised pattern recognition methods to predict the outcome of patients with neuroblastoma. More specifically, the invention relates to the use of supervised pattern recognition methods, such as artificial neural networks for the prognosis of patients with neuroblastoma using high dimensional data, such as gene expression profiling data.

BACKGROUND OF THE INVENTION

Diagnosis and/or prognosis of disease is based on a myriad of factors, both objective and subjective, including but not limited to symptoms, laboratory test values, demographic factors and environmental factors. Diagnosis and/or prognosis relies on a clinician such as a physician or a veterinarian being able to identify and evaluate the relevant factors. Often this task can be difficult, and becomes exceedingly more so as the number of factors to be considered increases.

An example of a disease whose diagnosis or prognosis is difficult is cancer. Cancer may be diagnosed or prognosis developed on the basis of clinical presentation, routine histology, immunohistochemistry and electron microscopy. However, the histological appearance may not reveal the genetic aberrations or underlying biologic processes that contribute to the malignancy. Monitoring global gene expression levels using DNA microarrays could provide an additional tool for elucidating tumor biology as well as the potential for molecular diagnostic classification of cancers. Several studies have demonstrated that gene expression profiling using DNA microarrays is able to classify tumors with a high accuracy, and discover new cancer classes.

In clinical practice, several techniques are used for diagnosis or prognosis, including immunohistochemistry, cytogenetics, interphase fluorescence in situ hybridization and reverse transcription (RT)-PCR. Immunohistochemistry allows the detection of protein expression, but it can only examine one protein at a time. Molecular techniques such as RT-PCR are used increasingly for diagnostic confirmation following the discovery of tumor-specific translocations such as EWS-FLI1; t(11;22)(q24;q12) in EWS, and the PAX3-FKHR; t(2;13)(q35;q14) in alveolar rhabdomyosarcoma (ARMS). However, molecular markers do not always provide a definitive diagnosis or prognosis, as on occasion there is failure to detect the classical translocations, due to either technical difficulties or the presence of variant translocations.

DNA microarray technology is a recently developed high throughput technology for monitoring gene expression at the transcription level. Its use is akin to performing tens of thousands of northern blots simultaneously, and has the potential for parallel integration of the expression levels of an entire genome. A DNA microarray includes DNA probes immobilized on a solid support such as a glass microscope slide. The DNA probes can be double stranded cDNA or short (25 mers) or long (50-70 mers) oligonucleotides of known sequences. An ideal DNA microarray should be able to interrogate all of the genes expressed in an organism.

In DNA microarrays using cDNA, the probes are PCR amplified from plasmid cDNA clones that have been purified and can be robotically printed onto coated glass slides. DNA microarrays using oligonucleotides have an advantage over cDNA microarrays because physical clones are not necessary. The oligonucleotides can either be previously synthesized and printed on glass slides, or can be synthesized directly on the surface of silicon or glass slides. Several print-ready oligonucleotide (60-70 mers) sets are commercially available for human, mouse and other organisms (http://www.cgen.com, http://www.operon.com).

Another technique for fabricating oligonucleotides microarrays chemically synthesizes the oligonucleotides (25 mers) on a silicon surface using photolithography techniques. (Affymetrix Inc., Santa Clara, Calif.). Originally such arrays were designed to detect single-nucleotide mutations, but now have applications for gene expression profiling studies. Yet another technique delivers single nucleic acids, which ultimately form longer oligonucleotides (60 mers), by ink-jet onto glass surfaces.

One method of utilizing gene expression data from microarrays is given by Tusher et al., PNAS 98(9) p. 5116-21, April, 2001. The method of Tusher et al. is a statistical method titled Significance Analysis of Microarrays ("SAM"). The general approach in SAM is based on commonly used statistical tests, t-tests specifically, to find genes that discriminate between two classes in a gene-by-gene fashion. SAM uses replication of experiments to assign a significance to the discriminating genes in terms of a false discover rate. SAM therefore offers a method of choosing particular genes from a set of gene expression data, but does not offer a diagnosis based on those genes.

Gene-expression profiling using DNA microarrays may permit a simultaneous analysis of multiple markers, and can be used for example to categorize cancers into subgroups or provide other information concerning the relationship of the gene expression profile and the disease state. The only limitation associated with the use of DNA microarrays is the vast amount of data generated thereby. A method that would allow for the easy and automated use of DNA microarray data in disease diagnosis or prognosis is therefore desirable. Therefore, there remains a need for a method of using gene expression data to diagnose, predict, or prognosticate about a disease condition.

SUMMARY OF THE INVENTION

In accordance with one embodiment of the invention, there is provided a selection of genes, expressed in a patient with neuroblastoma, that functions to predict the outcome of the patient when the expression of a gene selection from the cancer cell is compared to the expression of an identical selection of genes from a noncancerous cell or an identical selection of genes from a cancer cell from a patient with a good outcome and/or porr outcome. Devices for carrying out the above methods of the invention are also included within the scope of the invention.

Another embodiment of the invention includes a method of targeting a product of at least one of the genes in Table 2 that includes identifying a therapeutic agent. Another embodiment of the invention includes a method of targeting a product of at least one of the genes in Table 3 that includes identifying a therapeutic agent having an effect on said gene product.

Another embodiment of the invention provides a method of predicting, and/or prognosticating about a disease including obtaining experimental data, wherein the experimental data includes high dimensional data, filtering noise from the data, reducing the dimensionality of the data by using one or more methods of analysis, training a supervised pattern recognition and/or classification method, ranking individual data from the overall data based on the relevance of the individual data to the diagnosis, prediction, prognosis or classification, choosing multiple individual data members, wherein the choice is based on the relative ranking of the individual data, and using the chosen data to determine if an unknown set of experimental data indicates a particular disease prognosis, or prediction. Methods of the invention may utilize linear methods, and preferably, methods of the invention use nonlinear (with hidden layers) networks.

Methods of the invention can be utilized in a number of different applications. For example, diagnostic chips can be fabricated based on the identification of the diagnostic or prognostic genes. Such chips would be very useful in clinical settings, as it would allow clinicians to diagnose cancers or provide a prognosis from a relatively small set of genes instead of purchasing entire gene sets.

Methods of the invention can also be used to define which patients with neuroblastoma are likely to respond to treatment. This would allow a physician to intensify treatment for those with a more negative prognosis based on their gene expression profiles as detected utilizing a method of the invention. One aspect of the invention includes a method of predicting the outcome of a patient having neuroblastoma comprising detecting an increase in expression of at least one gene selected from the group consisting of DLK1, SLIT3, PRSS3, and mixtures thereof in a neuroblastoma cell from the patient; wherein an increase in expression of at least one of the genes is indicative of poor outcome of the subject.

Another method of predicting the outcome of patient having neuroblastoma comprises detecting a change in expression at least one gene or polynucleotide selected from the group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof, in a neuroblastoma cell from the patient, wherein the expression profile of the gene or polynucleotide is indicative of the outcome of the patient.

In some embodiments of the methods, the expression of at least one of the genes or polynucleotides selected from the group consisting of MYCN, DLK1, PRSS3, ARC, SLIT3, JPH1, Hs. 434957, Hs. 346735, Hs. 120591, and mixtures thereof, is upregulated, indicating the outcome of the patient is poor. In other embodiments, the expression of at least one gene or polynucleotide selected from the group consisting of CD44, ARH1, CNR1, ROBO2, BTBD3, KLRC3, Hs. 196008, Hs. 124776, Hs. 119947, Hs. 349094, and mixtures thereof, is downregulated, indicating the outcome of the patient is poor.

In some embodiments all of the genes or polynucleotides of Table 2 are analyzed. In other embodiments at least one or all of the genes of Table 3 are analyzed.

Another aspect of the invention includes a set or selection of genes or polynucleotides comprising at least two genes or polynucleotides selected from the consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof, or the complements thereof. The set of genes may further comprise MYCN and/or CD44.

Methods of the invention can also be used for identifying pharmaceutical targets. Methods of the invention can be used to determine which genes to target in efforts to target specific diseases. Such methods include a method of identifying an agent that can modulate the expression or activity of at least one gene or polynucleotide comprising measuring expression or activity of at least one polynucleotide or gene selected from the group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof, in the presence or absence of a candidate agent; and identifying the candidate agent that inhibits or increases expression or activity of the polynucleotide or gene. Another method comprises measuring expression or activity of at least one gene or polynucleotide selected from the group consisting of DLK1, PRSS3, ARC, SLIT3, JPH1, Hs. 434957, Hs. 346735, Hs. 120591, and mixtures thereof, in the presence or absence of the candidate antagonist; determining whether the candidate antagonist inhibits expression or activity of at least one of the polynucleotides or genes. In another embodiment, a method of identifying an agonist comprises measuring expression or activity of at least one polynucleotide or gene selected from the group consisting of ARH1, CNR1, ROBO2, BTBD3, KLRC3, Hs. 196008, Hs. 124776, Hs. 119947, Hs. 349094, and mixtures thereof, in the presence and absence of the candidate agonist; and determining whether the candidate agonist increases expression and/or activity of the polynucleotide or gene.

Another aspect provides for kits, devices for implementing the methods of the invention.

Methods of the invention can also be utilized as a research tool for analyzing all types of gene expression data including cDNA and oligonucleotide microarray data. Methods of the invention can also be utilized to identify and rank, by importance, the genes that contribute to a prognosis. A minimal set of genes that can correctly predict clinical outcomes can also be determined using methods of the invention. Methods of the invention identify the most significant genes, by calculating the sensitivity of the classification to a change in the expression level of each gene. A list of genes, ranked by their significance to the classification, is produced thereby. This allows for cost effective fabrication of subarrays for use in predicting clinical outcomes.

BRIEF DESCRIPTION OF THE FIGURES

FIG. 3 illustrate a set of processing modules making up an embodiment of an artificial neural network according to the invention.

DETAILED DESCRIPTION OF THE PREFERRED EMBODIMENTS

The invention is a method of classifying, diagnosing, prognosticating about, and predicting disease conditions or other biological states using supervised pattern recognition methods to analyze high dimensional data.

Figure 1:
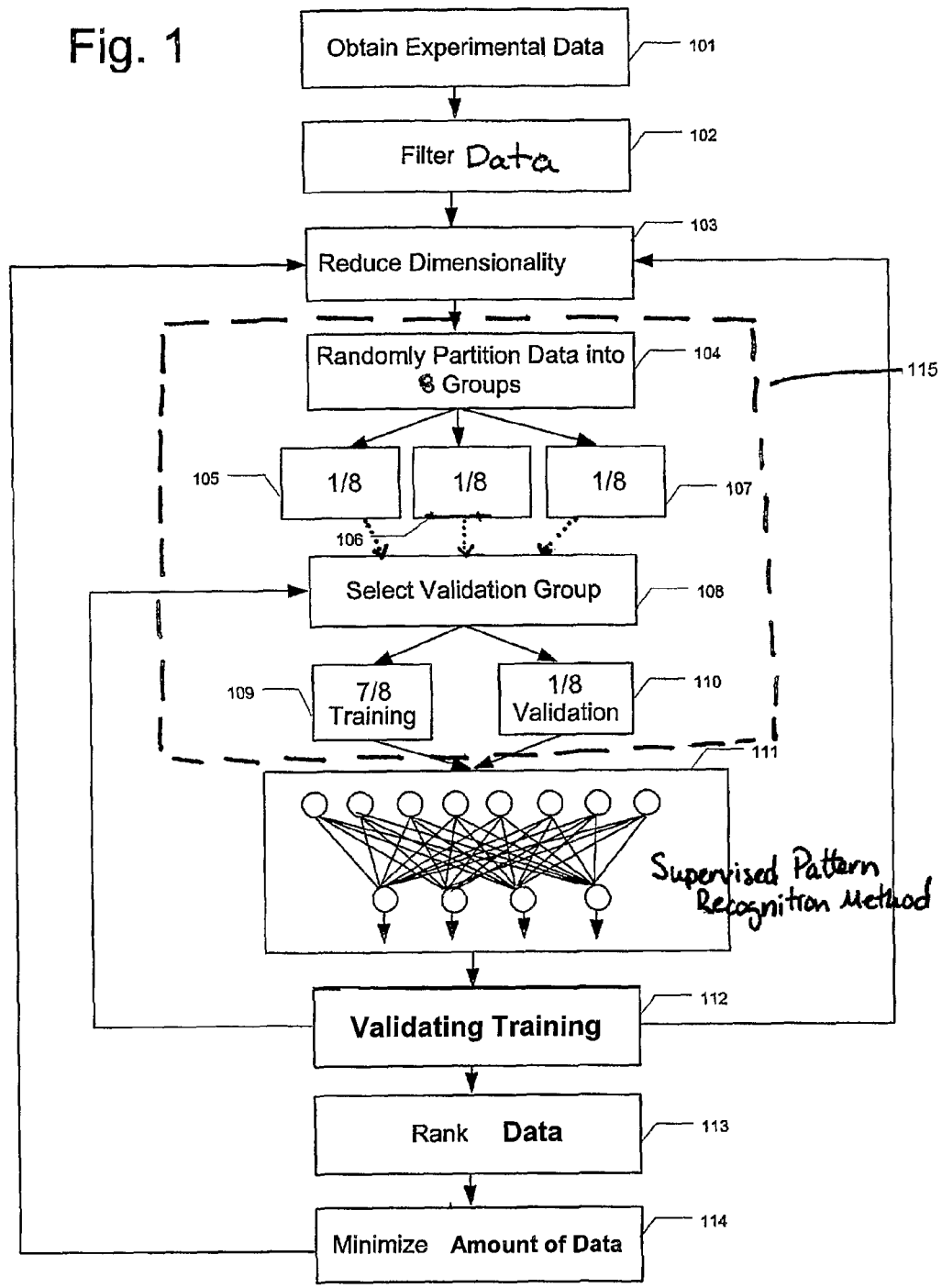
FIG. 1 illustrates a process flow for a method to identify a prognostic expression profile using artificial neural networks according to one embodiment of the invention.

One aspect of the invention is illustrated in FIG. 1. This embodiment exemplifies a method of using supervised pattern recognition methods to analyze high dimensional data. This process flow describes an embodiment of the method that includes obtaining experimental data 101, filtering the data 102, reducing the dimensionality of the data 103, setting up a validation method 115, training a supervised pattern recognition method 111, validating the outcome of the supervised pattern recognition method 112, and once the supervised pattern recognition method is validated, ranking the data based on the outcome of the supervised pattern recognition method 113. Further detail and more specific embodiments of methods of the invention are described below.

Supervised pattern recognition methods are useful, interalia, to analyze gene expression profiles useful to diagnose and/or provide prognosis of disease. One aspect of the invention, provides for a method for predicting the outcome of a patient or subject having neuroblastoma comprising detecting an increase in expression of at least one gene in a neuroblastoma cell from the patient selected from the group consisting of DLK1, PRSS3, SL1T3 and mixtures thereof, wherein the increase in expression is indicative of poor outcome. In some embodiments, an increase in expression is determined by detecting mRNA expression as compared to a nonneuroblastoma cell, for example, from a mixture of other types of cancer cells. In other embodiments, expression is compared to expression in a cell from a neuroblastoma tumor from a subject with a good outcome and/or a poor outcome. In some embodiments, a control may also be employed to detect the expression of 5-10 housekeeping genes. The invention also includes another method for predicting the outcome of a patient or subject having neuroblastoma comprising detecting a change in expression of at least one gene or polynucleotide or all genes or polynucleotides selected from the group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof, in a neuroblastoma cell from the patient, wherein the expression profile or change in expression of the gene or polynucleotide is indicative of the outcome of the patient. In some embodiments, a change in expression is determined as compared to a nonneuroblastoma cell or as compared to expression in a cell from a neuroblastoma tumor from a subject with a good outcome and/or a poor outcome.

In some embodiments, the methods further comprise detecting the expression of MYCN and/or CD44. In some embodiments, at least one of the genes or polynucleotides selected from the group consisting of DLK1, PRSS3, ARC, SLIT3, JPH1, Hs. 434957, Hs. 346735, Hs. 120591 and mixtures thereof, is upregulated indicating that the outcome of the patient is poor. In other embodiments, at least one gene or polynucleotide selected from the group consisting of ARH1, CNR1, ROBO2, BTBD3, KLRC3, Hs. 196008, Hs. 119947, Hs. 124776, Hs. 349094, and mixtures thereof, is downregulated indicating that the outcome of the patient is poor.

Another aspect of the invention involves a method of targeting a gene or polynucleotide for treatment for neuroblastoma. A method comprises identifying an antagonist or agonist of at least one gene or polynucleotide for which a change in expression is correlated with poor outcome in a patient or subject having neuroblastoma. In some embodiments, the gene or polynucleotide is upregulated in a tumor cell and is associated with poor outcome. If a gene is upregulated, a method comprises identifying an antagonist of the gene or polynucleotide. A gene or polynucleotide that is upregulated comprises or is selected from the group consisting of DLK1, PRSS3, SLIT3, and mixtures thereof. In other embodiments, a gene or polynucleotide selected from the group consisting of DLK1, PRSS3, ARC, SLIT3, JPH1, and mixtures thereof, is upregulated indicating a poor outcome. A method comprises identifying an antagonist of at least one gene or polynucleotide upregulated in neuroblastoma cell comprising measuring expression or activity of at least one gene or polynucleotide selected from the group consisting of DLK1, PRSS3, ARC, SLIT3, JPH1, Hs. 434957, Hs. 346735, Hs. 120591, and mixtures thereof in the presence or absence of a candidate agent; and identifying the candidate agent that inhibits expression or activity of at least one of the genes.

In some embodiments, at least one gene or polynucleotide is downregulated and correlated with poor outcome of a patient having neuroblastoma. When a gene or polynucleotide is downregulated, a method comprises identifying an agonist of a gene or polynucleotide downregulated in a neuroblastoma cell comprising measuring expression or activity of at least one gene or polynucleotide selected from the group consisting of ARH1, CNR1, ROBO2, BTBD3, KLRC3, Hs. 196008, Hs. 124776, Hs. 119947, Hs. 349094, and mixtures thereof, in the presence and absence of a candidate agent, identifying as an agonist the candidate agonist that increases the expression or activity of the gene or polynucleotide.

Another aspect of the invention provides a set or selection of genes, kits, and devices for carrying out the methods of the invention.

A. Methods of Using Supervised Pattern Recognition to Analyze High Dimensional Data for Prognosis and Identifying Therapeutic Targets.

An embodiment of the invention provides a method of predicting, and/or prognosticating about a disease comprising obtaining experimental data, wherein the experimental data includes high dimensional data, filtering noise from the data, reducing the dimensionality of the data by using one or more methods of analysis, training a supervised pattern recognition and/or classification method, ranking individual data from the overall data based on the relevance of the individual data to the diagnosis, prediction, prognosis or classification, choosing multiple individual data members, wherein the choice is based on the relative ranking of the individual data, and using the chosen data to determine if an unknown set of experimental data indicates a particular disease prognosis, or prediction.

Obtaining Experimental Data

The first step in a method of the invention is to obtain experimental data. Experimental data utilized in methods of the invention is high dimensional data. High dimensional data is data that has at least hundreds of individual pieces of information associated with one sample. An example of high dimensional data useful in methods of the invention is gene expression data. Gene expression data is high dimensional data because each sample has a large number of gene expression levels. Generally speaking, gene expression data generally has thousands of gene expression levels for each sample. Other examples of high dimensional data useful in the invention include but are not limited to protein arrays and protein chips, cell array based expression analysis, analysis of patterns of single nucleotide polymorphisms in disease conditions, and comparative genomic hybridization on metaphase, BAC genomic, cDNA and oligonucleotide arrays.

Preferably, the gene expression data is obtained through use of DNA microarray technology. DNA microarrays are preferred as a source of data because they generally offer a more complete picture of the interactions of a large number of genes with a limited number, or even one experiment. An example of a general description of how gene expression data can be obtained by using cDNA microarray technology is given below.

DNA microarrays, although a relatively new technology, have already been saddled with a number of different names, biochip, DNA chip, gene chip, genome chip, cDNA microarray, and gene array. The use of any of these terms herein refers generally to DNA microarrays. The underlying principle of DNA microarrays is base pairing or hybridization i.e., A-T and G-C for DNA, and A-U and G-C for RNA.

DNA microarrays provide a medium for matching known and unknown DNA samples based on the base pairings given above. DNA microarrays can either be fabricated by high-speed robotics or can be fabricated in a laboratory setting. They are generally patterned on glass, but can also be fabricated on nylon substrates. Microarrays generally have sample spot sizes of less than 200 µm diameter, and generally contain thousands of DNA spots on one microarray.

One method of fabricating cDNA microarrays begins by first producing gene-specific DNA by polymerase chain reaction (PCR) amplification of purified template plasmid DNAs from cloned expressed sequence tags (ESTs). The PCR product is then purified, resuspended and printed onto a substrate. DNA microarrays are also commercially available from a number of sources, including but not limited to Affymetrix, Inc. (Santa Clara, Calif.), Agilent Technologies (Palo Alto, Calif.), and Research Genetics (Huntsville, Ala.).

One general procedure for a cDNA microarray experiment begins by preparing DNA samples and arraying them (either with an arraying robot, or by hand), to form a DNA microarray. Next, the RNA samples are extracted from the cells of interest, purified, reverse transcribed into cDNA and differentially fluorescently labeled to create probes. Then, the fluorescently labeled cDNA probes are hybridized to the cDNA microarray. If a probe contains a cDNA whose sequence is complementary to the DNA on a given spot, the cDNA probe will hybridize to that spot. After the cDNA probes are hybridized to the array, and any loose probe has been washed away, the microarray is imaged to determine how much of each probe is hybridized to each spot. This indicates how much of each gene from the microarray is expressed in the two samples. If the amount of starting material is small, for example from needle biopsies, the RNA can first be subject to amplification by modified Eberwine methods as described by Gelder et al. (Amplified RNA synthesized from limited quantities of heterogeneous cDNA. (Proc. Natl. Acad. Sci. USA 1990 March; 87(5):1663-7).) The experimental high dimensional data, preferably obtained from gene expression experiments, preferably performed using cDNA microarrays, is then further analyzed by a method of the invention.

Filtering the Data

The next step in a method of the invention is filtering the data 102 to remove individual pieces of data that are deemed undesirable. This filtering step functions to eliminate weak and/or problematic data from further use in the method. Accomplishment of the step of filtering depends greatly on the type of high dimensional data utilized. Any method known to those of ordinary skill in the art can be used to eliminate data determined to be undesirable.

One basis for carrying out this filtering, if a DNA microarray is being utilized for obtaining the high dimensional data, is the intensity of the fluorescence from the individual microarray spots. This basis of omitting data is based on failure or error in the imaging of the specific spots. A preferred method of performing initial data filtering on cDNA microarray data to remove those spots where imaging was a problem is to utilize the intensity of the various spots and utilize only those spots that have an intensity over a certain threshold value. Other methods of filtering DNA microarray data include but are not limited to eliminating spots in which the number of pixels represented is less than a threshold defined by the user, eliminating spots in which the standard deviation of the signal on the spots is too large, as defined by the user, eliminating spots in which the background intensity of a single spot is too high, or any combination thereof. In addition quality values based on intensity, can be assigned to each spot, standard deviation of intensity, background and/or size of each spot, then a spot could be eliminated if its quality value falls below a threshold as defined by the user.

Reducing the Dimensionality of the Data

The next step in methods of the invention is reducing the dimensionality of the data 103. The number of samples needed to calibrate a classifier with good predictive ability, depends critically on the number of features used in the design of the classifier. In the case of high-dimensional data, such as microarray data, where the number of samples is much smaller than the number of individual pieces of data there exists a large risk of over-fitting. There are two different solutions to this problem. First, the calibration process can be carefully monitored using a cross-validation scheme to avoid over-fitting (see below). Second, the dimension of the data can be reduced, either by using a dimensional reduction algorithm or by selecting a smaller set of data for input to the supervised pattern recognition method. Dimensionality reduction allows the number of parameters representing each sample to be reduced. This allows for the design of a classifier that has less risk of over-fitting, thereby increasing its predictive ability. Examples of methods of reducing the dimensionality of the data include but are not limited to principal component analysis (PCA), weighted gene analysis, t-test, rank based Wilcoxon or Mann-Whitney tests, signal-to-noise statistic, Fisher's discriminant analysis, or ANOVA tests. In a preferred embodiment of the invention, PCA is used to reduce the dimensionality of the data.

In the case of PCA on gene expression data, reduction of the dimensionality is achieved by rotating gene expression space, such that the variance of the expression is dominated by as few linear combinations of genes as possible. Even though the formal dimension of the problem is given by the number of individual data points, the effective dimension is just one less than the number of samples. Hence the eigenvalue problem underlying PCA can be solved without diagonalizing 2308×2308 matrices by using singular value decomposition. Thus each sample is represented by 88 numbers, which are the results of projections of the data using the PCA eigenvectors.

A potential risk when using PCA on relatively few samples is that components might be singled out due to strong noise in the data. It could be argued that the outputs (labels) should be included in the dimensional reduction, using e.g. the Partial Least Squares (PLS) algorithm, in order to promote components with strong relevance for the output. However, based on explorations with similar data sets, this is not optimal; bias is introduced and implicitly "over-trains" from the outset by including the outputs in the procedure.

Setting Up a Validation Method for the Supervised Pattern Recognition Method

Once the data has been filtered 102 and its dimensionality reduced 103, a validation method is set up for monitoring and validating the training of the supervised pattern recognition method 115. Any method commonly used by those of skill in the art for validating the training of a supervised pattern recognition method can be used.

In one embodiment, the first step in setting up a validation method is to randomly divide the data into eight groups of data. (See FIG. 4A.) Then, one of those groups is chosen as a validation group 108. The remaining 7 groups are combined into a training group 109, which is used to train the supervised pattern recognition method 111 and the eighth group 108 is used to validate the performance of the supervised pattern recognition method 111, once trained, and is called a validation group 110.

In an embodiment, the 8-fold cross validation procedure (steps 104 through 110) is performed on all of the samples. A data group having a known number of samples is given as an example. The known (labeled) number samples are randomly shuffled 104 and split into equally 8 sized groups. The supervised pattern recognition method 111 is then calibrated as discussed below using the training group 109. The eighth group, a validation group 110, is reserved for testing predictions. Comparisons with the known answers refer to the results from the validation group 110 (i.e. when using a model, the samples used for training the model are never used in predictions). This procedure is repeated 8 times, each time with a different group used for validation. The random shuffling 104 is done about 100 to 10000 times, preferably 100 times. For each shuffling, one supervised pattern recognition method 111 model is generated. Thus, in this embodiment, in total, each sample belongs to validation group 110, 100 times and 800 supervised pattern recognition methods 111 have been calibrated. Other cross validation schemes can be designed and readily utilized.

Training the Supervised Pattern Recognition Method

The supervised pattern recognition method 111 is then trained. The specific method of training the supervised pattern recognition method 111 is dependent on the specific form that the supervised pattern recognition method 111 takes. The choice of the supervised pattern recognition method 111 and the training thereof is well within one of skill in the art, having read this specification.

One example of a supervised pattern recognition method is an artificial neural network (ANN). ANNs are computer-based algorithms that are modeled on the structure and behavior of neurons in the human brain and can be trained to recognize and categorize complex patterns. Pattern recognition is achieved by adjusting parameters of the ANN by a process of error minimization through learning from experience. They can be calibrated using any type of input data, such as gene-expression levels generated by cDNA microarrays, and the output can be grouped into any given number of categories. ANNs have been recently applied to clinical problems such as diagnosing myocardial infarcts and arrhythmias from electrocardiograms and interpreting radiographs and magnetic resonance images.

In some embodiments where an artificial neural network (ANN) is employed as the supervised pattern recognition method 111, calibration is preferably performed using MATLAB (The Mathworks, Natick, Mass.), preferably, the resilient backpropagation learning algorithm is used with initial delta=0.07, max delta=50, delta increase=1.2, and the delta decrease=0.5. The calibration is performed using a training set and it is monitored both for the training set and a validation set, which is not subject to calibration (see below). The weight values are updated and the calibration is terminated after 100 passes (epochs) through the entire training set. In one embodiment of a method of the invention, the resulting parameters for the completed training of a supervised pattern recognition method 111 defines a "model".

The possibility of using all the PCA components as inputs followed by a subsequent pruning of weights to avoid "overfitting" is also one alternative.

Verifying the Outcome of the Supervised Pattern Recognition Method

Once the supervised pattern recognition method 111 is trained, the next step is to determine whether the validation of the supervised pattern recognition method 111 is successful 112. This step determines whether the supervised pattern recognition method 111 adequately predicted the results for the validation data set 110 using any number of performance measurements and error measurements.

Any method known to those of ordinary skill in the art can be utilized to evaluate the performance of the training of the supervised pattern recognition method 111. Generally speaking, the performance is evaluated by comparison with some predetermined level of correct predictions that the user has determined is acceptable.

If the performance of the supervised pattern recognition method 111 is sufficiently poor, and a measure of error is greater than an allowable threshold, the processing may return to module 103 where the dimensionality of the data is reduced in a different manner and the entire training and validation process is repeated.

Ranking the Data

Once module 112 determines that the network 111 has been adequately trained, the processing proceeds to rank the output of the supervised pattern recognition method 113.

The outcome of the supervised pattern recognition method 111 can be looked at either independently or in a compiled form. Each supervised pattern recognition method 111 gives a number between 0 (good outcome) and 1 (poor outcome) as an output for each sample. If the predictions are viewed independently, the maximal output is forced to 1 while the other outputs are forced to 0. Then it is determined how many of the predictions are correct. If the predictions are viewed in a compiled form, all of the predicted outputs are considered in their numerical form, after which all of the numbers are averaged and the resulting average is forced to 0 or 1. In one embodiment of the method, the predictions, as compiled, are used to classify samples.

In one embodiment, each sample is classified as belonging to the good or poor outcome corresponding to the largest average in the compilation. Optionally, in addition, it may be desirable to be able to reject the second largest vote, as well as test samples that do not fall within a distance $d_c$ from a sample to the ideal vote for each outcome type is defined as $$d_c = \frac{1}{2}\sum_{i=1}^{4}(o_i - \delta_{i,c})^2 \tag{1}$$

where c is a outcome type, $o_i$ is the average from the compilation for outcome type i, and $\delta_{i,c}$ is unity if i corresponds to outcome type c and zero otherwise. The distance is normalized such that the distance between two ideal samples belonging to different outcome types is unity. Optionally, based on the validation group, an empirical probability distribution of its distances is generated for each outcome type.

Optionally, empirical probability distributions may be built using each supervised pattern recognition method 111 independently (not the average from the compilation). Thus, the number of entries in each distribution is given by 100 multiplied by the number of samples belonging to the outcome type. For a given test sample, the possible classifications based on these probability distributions can be rejected. This means that for each outcome type a cutoff distance from an ideal sample is defined, within which, based on the validation samples, a sample of this category is expected to be. The distance given by the 95th percentile of the probability distribution is preferably chosen as a cutoff, which means that if a sample is outside of this cutoff distance it cannot confidently provide a prognosis. It should be noted that the classification as well as the extraction of important genes (see below) converges using less than 100 supervised pattern recognition method 111 models. 800 supervised pattern recognition method 111 models are preferred is because sufficient statistics exist for these empirical probability distributions.

For each output category the sensitivity and specificity of the prognosis may be calculated (see Table 1 below). Table 1 gives sensitivity, specificity for both validation and test samples. Both the sensitivity and the specificity are very high for all categories. It should be noted, that they generally depend on the kind of samples that are used as test samples.

Neuroblastoma Prognosis Using Gene Expression Profiling

TABLE 1

PERFORMANCE OF ANN PREDICTION

| ANN prediction | Sensitivity (%) poor-outcome | Specificity (%) poor-outcome | Positive predictive value (%) poor-outcome | Positive predictive value (%) good-outcome |
|---|---|---|---|---|
| Leave-one-out with all clones (n = 49) | 84 | 90 | 84 | 90 |
| 19 genes (test samples; n = 21) | 100 | 94 | 83 | 100 |
| 19 genes (n = 49) | 100 | 97 | 95 | 100 |

The Receiver Operator Characteristic (ROC) curve area is identical to another more intuitive and easily computed measure of discrimination: the probability that in a randomly chosen pair of samples, one belonging to and one not belonging to the outcome category, the one belonging to the category is the one with the closest distance to the ideal for that particular category. Since the ROC curve areas are unity for all output categories, it is possible to define cutoff distances such that both the sensitivity and the specificity are 100% for all outcomes. However, based on the training and validation groups it is difficult to motivate such cutoff distances.

The next step in a method in accordance with the invention is to actually rank the data. This step can in principle be done in two ways; (1) model-independent and (2) model-dependent analysis respectively. Due to the relative small number of samples, the model-dependent analysis is preferred when using ANN models.

The sensitivity (S) of the outputs (o) with respect to any of the input variables ($x_k$) is defined as:

$$S_k = \frac{1}{N_s} \frac{1}{N_o} \sum_{s=1}^{N_s} \sum_{i=1}^{N_o} \left| \frac{\delta o_i}{\delta x_k} \right| \qquad (2)$$

where $N_s$ is the number of samples and $N_o$ is the number of outputs (4). The procedure for computing $S_k$ involves a committee of models. In addition we have defined a sensitivity for each output i ($S_i$), which is analogous to Eq. (2) but without the sum over outputs. Furthermore, a sensitivity can be defined for each sample (or subsets of samples) individually, by only using that sample(s) in the sum over samples in Eq. (2). For all these sensitivities the sign of the sensitivity has also been defined. The sign signals whether the largest contribution to the sensitivity stems from positive or negative terms. A positive sign implies that increased expression of the gene increases the possibility that the sample belongs to the poor outcome type, (P+ means higher expression in the death or poor outcome group) while a negative sign means decreased expression of the gene is associated with poor outcome (P− means decreased expression in poor outcome group).

In one embodiment, once ranked, a relevant set of data can be selected module 114 by minimizing the amount of data to be used to classify and identify a particular disease. In one embodiment, a predetermined amount of data having the highest ranking are selected. Of course, other selection methods may be employed without deviating from the spirit and scope of the present invention as recited in the attached claims.

Implementation of Methods of the Invention

Figure 2:
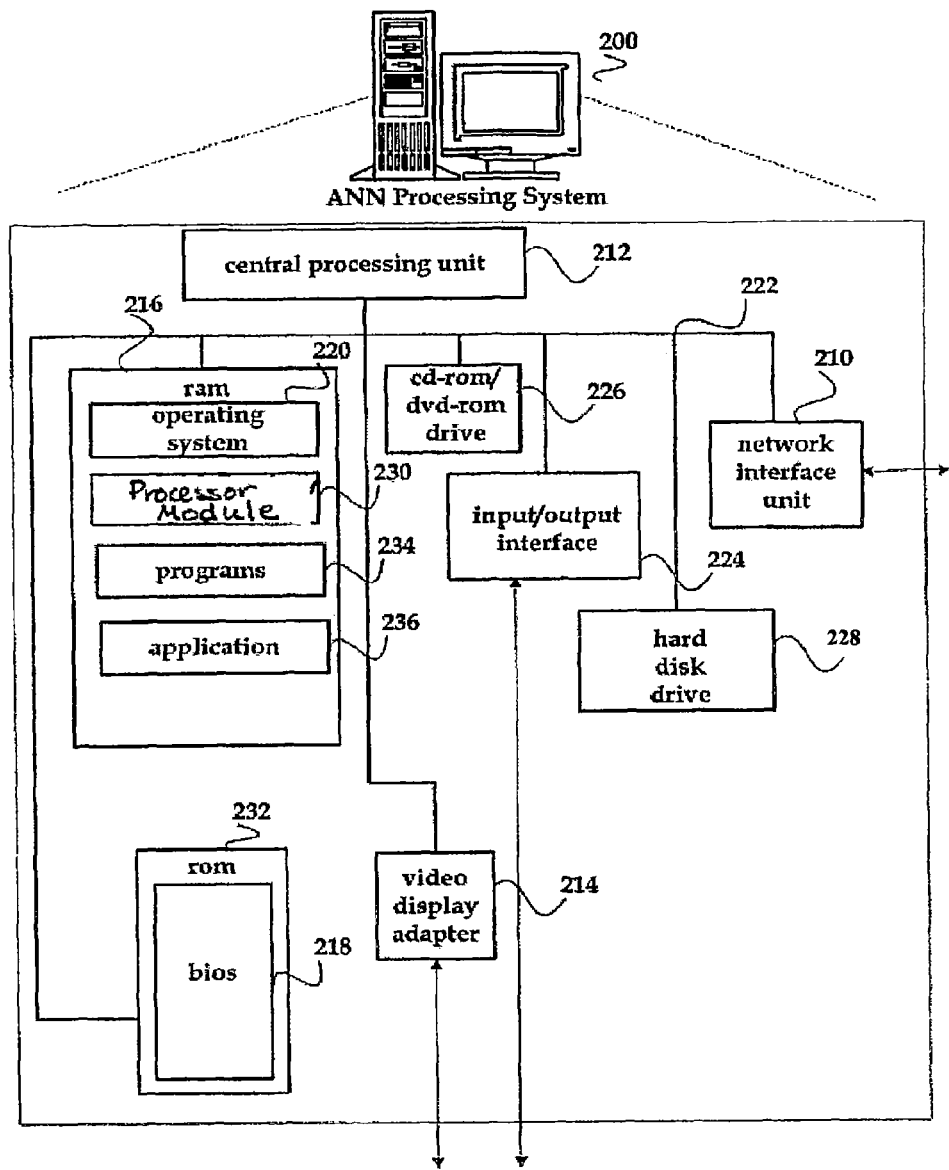
FIG. 2 illustrates a general purpose computing system utilized as part of an artificial neural network according to another embodiment of the invention.

In embodiments of the method in which the supervised pattern recognition method 111 is an artificial neural network, a general purpose computing system as depicted in FIG. 2 can be utilized. An exemplary ANN processing system 200 provides an artificial neural network that also receives experimental data to train the artificial neural network, to verify the output of an artificial neural network, and to identify relevant genes using the neural network.

Those of ordinary skill in the art will appreciate that the ANN processing system 200 may include many more components than those shown in FIG. 2. However, the components shown are sufficient to disclose an illustrative embodiment for practicing the present invention. As shown in FIG. 2, the ANN processing system 200 is connected to a WAN/LAN, or other communications network, via network interface unit 210. Those of ordinary skill in the art will appreciate that network interface unit 210 includes the necessary circuitry for connecting the ANN processing system 200 to a WAN/LAN, and is constructed for use with various communication protocols including the TCP/IP protocol. Typically, network interface unit 210 is a card contained within the ANN processing system 200.

The ANN processing system 200 also includes processing unit 212, video display adapter 214, and a mass memory, all connected via bus 222. The mass memory generally includes RAM 216, ROM 232, and one or more permanent mass storage devices, such as hard disk drive 228, a tape drive, CD-ROM/DVD-ROM drive 226, and/or a floppy disk drive. The mass memory stores operating system 220 for controlling the operation of ANN processing system 200. It will be appreciated that this component may comprise a general purpose server operating system as is known to those of ordinary skill in the art, such as UNIX, LINUX, MAC OS®, or Microsoft WINDOWS NT®. Basic input/output system ("BIOS") 218 is also provided for controlling the low-level operation of ANN processing system 200.

The mass memory as described above illustrates another type of computer-readable media, namely computer storage media. Computer storage media may include volatile and nonvolatile, removable and non-removable media implemented in any method or technology for storage of information, such as computer readable instructions, data structures, program modules or other data. Examples of computer storage media include RAM, ROM, EEPROM, flash memory or other memory technology, CD-ROM, digital versatile disks (DVD) or other optical storage, magnetic cassettes, magnetic tape, magnetic disk storage or other magnetic storage devices, or any other medium which can be used to store the desired information and which can be accessed by a computing device.

The mass memory also stores program code and data for providing an ANN processing and network development. More specifically, the mass memory stores applications including ANN processing module 230, programs 234, and other applications 236. ANN processing module 230 includes computer executable instructions which, when executed by ANN processing system 200, performs the logic described above.

The ANN processing system 200 also comprises input/output interface 224 for communicating with external devices, such as a mouse, keyboard, scanner, or other input devices not shown in FIG. 2. Likewise, ANN processing system 200 may further comprise additional mass storage facilities such as CD-ROM/DVD-ROM drive 226 and hard disk drive 228. Hard disk drive 228 is utilized by ANN processing system 200 to store, among other things, application programs, databases, and program data used by ANN processing module 230. For example, customer databases, product databases, image databases, and relational databases may be stored. The operation and implementation of these databases is well known to those skilled in the art.

A set of processing modules making up an embodiment of an artificial neural network according to the invention is illustrated in FIG. 3. The artificial neural network disclosed herein corresponds to a generic neural network of no particular topology for the network of nodes contained therein. The neural network typically utilizes a form of competitive learning for the operation of the nodes within the network. Within competitive learning networks, a large number of data vectors are distributed in a highly dimensional space. These data vectors represent known values for experimental data that typically reflect a probability distribution of the input experimental data. From this probability distribution representation, predictions for unknown values for similar input data may be determined.

In all of these competitive learning networks, the networks are typically presented a set of input data that possesses a corresponding set of results data. From these data values, the network of nodes "learns" a relationship between the input data and its corresponding results data. In this process, the probability distribution relationship is estimated using the multi-dimensional network of nodes. This relationship is represented within a set of artificial neural network coefficients for a particular topology of nodes.

One skilled in the art will recognize that competitive learning networks include a nearly infinite number of network topologies that may be used to represent a particular probability distribution relationship without deviating from the spirit and scope of the present invention as recited within the attached claims. In addition, artificial neural networks may utilize various well-known algorithm architectures, including hard-competitive learning (i.e. "winner-take-all" learning), soft competitive learning without a fixed network dimensionality, and soft competitive learning with a fixed network dimensionality, to specify an artificial neural network according to the invention as recited within the attached claims. Each of these algorithm architectures represents the same probability distribution relationship; however each of the various algorithm architectures better optimize corresponding processing parameters, which are often mutually exclusive with each other. These parameters include error minimization or the minimization of an expected quantization error, entropy maximization for the reference vectors used within a network, and topology-preserving or feature mapping architectures that attempt to map high-dimensional inputs signals onto lower-dimensional structures in a manner that attempts to preserve similar relationships found within the original data within the post-mapping data. As such, any of these types of algorithm architectures may be used to construct an artificial neural network without deviating from the spirit and scope of the present invention as recited within the attached claims.

Now referring to FIG. 3, an artificial neural network processing system 301 comprises a learning module 311, a prediction module 321, and a database of network node coefficients 313. The learning module 311 is used with a set of experimental data 315 that possesses a corresponding set of experimental results 316 to generate a set of network node coefficients that represent a probability distribution relationship for the experimental data 315—experimental result 316 data set for a particular neural network topology and algorithm architecture. The learning module 311 includes a data learning input module 312 that receives the experimental data 315—experimental result 316 data set generated using the process described above. The learning module 311 also includes an ANN training module 313 that processes the experimental data 315—experimental result 316 data set to generate the coefficients used to specify the probability distribution relationship and an ANN coefficient storage module 314 for storing the coefficients that have been previous generated within the database 313 for later use.

The data processing within the learning module 311 may proceed in a batch processing fashion in which all of the vectors within the experimental data 315—experimental result 316 data set are processed at a single time. In such a process, the experimental data 315—experimental result 316 data set is received by the input module 312, processed by the training module 313, and the generated coefficients are placed within the database 313 by the storage module 314. Alternatively, the experimental data 315—experimental result 316 data set may be processed as a sequence of smaller data sets in which the experimental data 315—experimental result 316 data set data values are generated at different times. In such a process, the training module 313 uses the previously stored coefficients retrieved by the storage module along with a new small data set provided by the input module 312 to generate an updated set of coefficients. These updated coefficients may be once again stored within the database 313 for use at a later time.

Once an artificial neural network 301 has been trained, the prediction module 321 may be used to predict, or classify, a particular test data value 325. The prediction module 321 includes a data prediction input module 322, an ANN prediction module 323, and an ANN curve slope module 324. The data prediction input module 322 receives the input test data generated as described above for use in the prediction module. The ANN prediction module 323 receives and utilizes the network coefficient values for the neural network from the ANN coefficient database 313 to predict the possible result for the probability distribution relationship specified within the neural network. This output value is used by the ANN curve slope module 324 to determine all possible values for a given gene, in the manner discussed above, to determine a curve slope value. This slope value is then output for later use in ranking and classifying the individual genes used to determine the presence, absence or prognosis of a disease.

The embodiments described herein are implemented as logical operations performed by a computer. The logical operations of these various embodiments of the present invention are implemented (1) as a sequence of computer implemented steps or program modules running on a computing system and/or (2) as interconnected machine modules or hardware logic within the computing system. The implementation is a matter of choice dependent on the performance requirements of the computing system implementing the invention. Accordingly, the logical operations making up the embodiments of the invention described herein can be variously referred to as operations, steps, or modules.

While the above embodiments of the invention describe the use of an artificial neural network to identify relevant genes associated with diseases and use the identified genes to classify and identify diseases, one skilled in the are will recognize that the use of the processing system discussed above are merely example embodiments of the invention. As long as experimental data is used to self-train a processing system using competitive learning processing, the present invention to would be useable in other data processing-systems. It is to be understood that other embodiments may be utilized and operational changes may be made without departing from the scope of the present invention as recited in the attached claims.

Prediction of Clinical Outcome Using Gene Expression Profiling and ANN

In an embodiment, a prognostic profile and prediction of clinical outcome of patients having neuroblastoma can be made using gene expression data and a method of analyzing the data using ANNs as described herein.

The high dimensional data is obtained from neuroblastoma tumor cells. In some embodiments, total mRNA from neuroblastoma cells is obtained and expression levels are determined using commercially available sequence verified cDNA libraries comprising about 42,578 cDNA clones representing 25,933 unique genes (Unigene clusters: 13,606 known genes and 12,327 unknown expressed sequence tags).

In an embodiment, gene expression ratio information obtained from neuroblastoma cells and reference RNA on each microarray can be normalized using a pin based normalization method. Quality of each individual cDNA can be evaluated by Chen et al. (Bioinformatics, 18:207 (2002)). Spots with an average quality across all of the samples can be excluded.

In an embodiment, principal component analysis can be used to reduce the dimensionality of the expression data to the principal components as inputs for artificial neural networks. A feed forward resilient back propagation multilayer perceptron artificial neural network (coded in Matlab, The Mathworks, Natick, Mass.) can be used having at least 3 layers: an input layer of the top 10 principal components of the data or the gene expression ratios of each cDNA spot (for the minimized gene set); a hidden layer with 3 nodes; and an output layer generating a committee vote that discriminates between two classes (i.e. good and poor outcome groups). Average artificial neural network committee votes can be used to classify samples and 0.5 can be selected as decision boundary. An ideal vote was 0 for good outcome group (alive) and 1 for poor outcome group (dead).

Figure 4A:
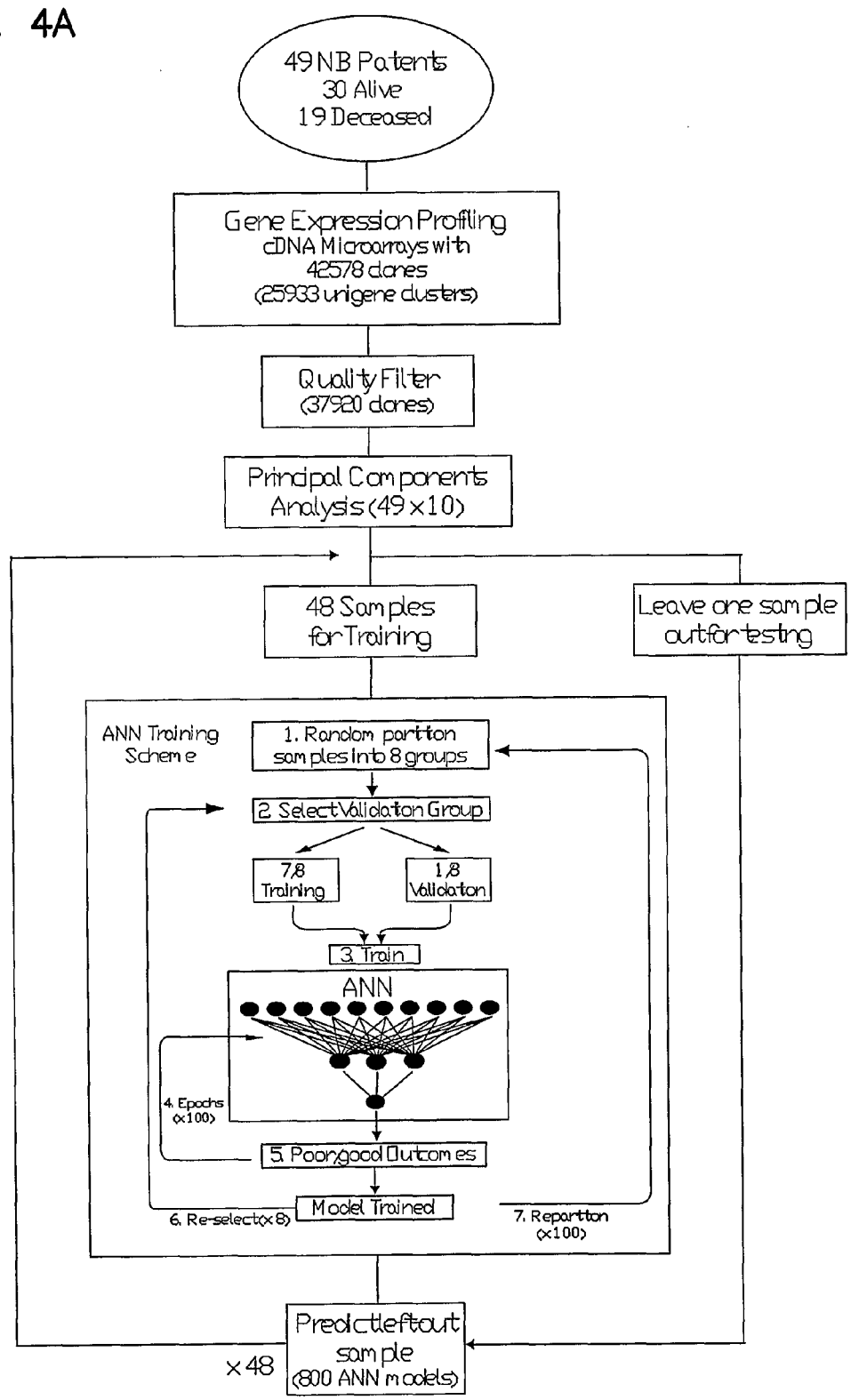
FIGS. 4A and B illustrate (A) workflow diagram for complete leave-one-out artificial neural network (ANN) analysis using all 37920 clones; and (B) workflow diagram for identifying prognostic gene expression signature and outcome prediction.

The artificial neural networks can be trained using an 8 fold cross validation scheme. (See FIG. 4A) In an embodiment, the top 10 principal components are used for input to the ANN. One sample is left out as an independent test sample, and the ANNs are trained using the remaining 48 NB samples as shown in FIG. 4A. All remaining neuroblastoma samples are randomly partitioned into eight groups. One of the eight groups (containing 6 samples each) is selected as a validation set, whereas the remaining 7 groups (42 samples) are used to train the network. The training weights are iteratively adjusted for 100 cycles (epochs). The ANN output (0-1, where 0=ideal good-outcome and 1=ideal poor-outcome) is calculated for each sample in the validation set. A different validation set is selected from the same partitioning of the initial set, and the remaining seven groups are used for training. The training scheme is repeated until each of the eight groups from the initial set are used as a validation set exactly one time. The samples are randomly repartitioned into eight new groups, and training steps are repeated. Sample partitioning was performed 100 times in total. Thus, training steps are repeated 100 times. Eight hundred ANN models are trained and are used to predict the left out test sample. This scheme can be repeated for each left out test sample.

In an embodiment, to identify the prognostic genes and outcome prediction, a separate ANN analysis is conducted using a gene minimization procedure. The gene minimization procedure involves ranking each of the input clones according to its importance to prediction of ANNs. Increasing numbers of the top ranked clones are used to to train ANNs and the classification error monitored. The minimal number of clones that yielded the minimal classification error is identified and the top ranked clones are used to retrain ANNs and predict the test samples without preforming a principal component analysis.

Figure 4B:
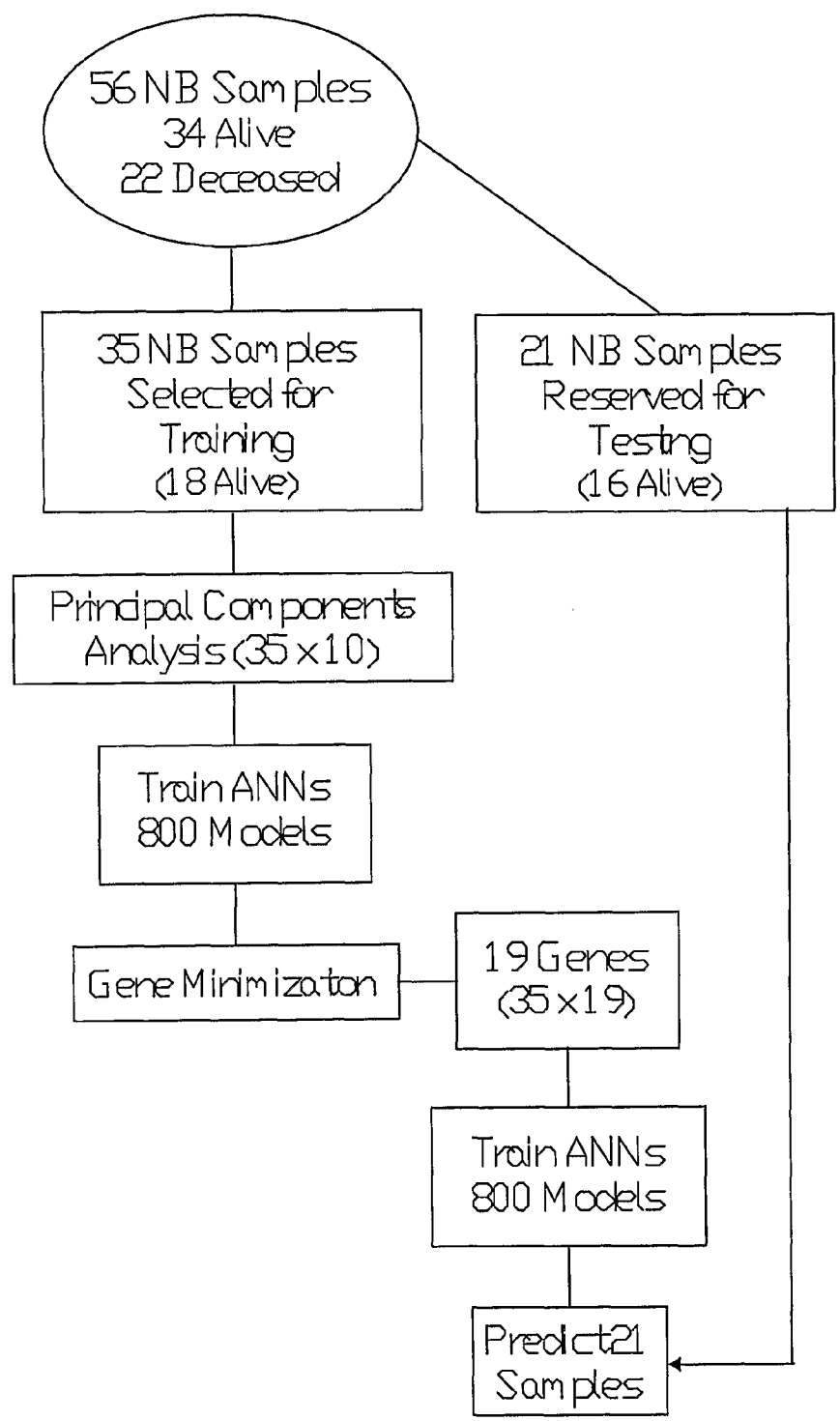
Figure 7A:
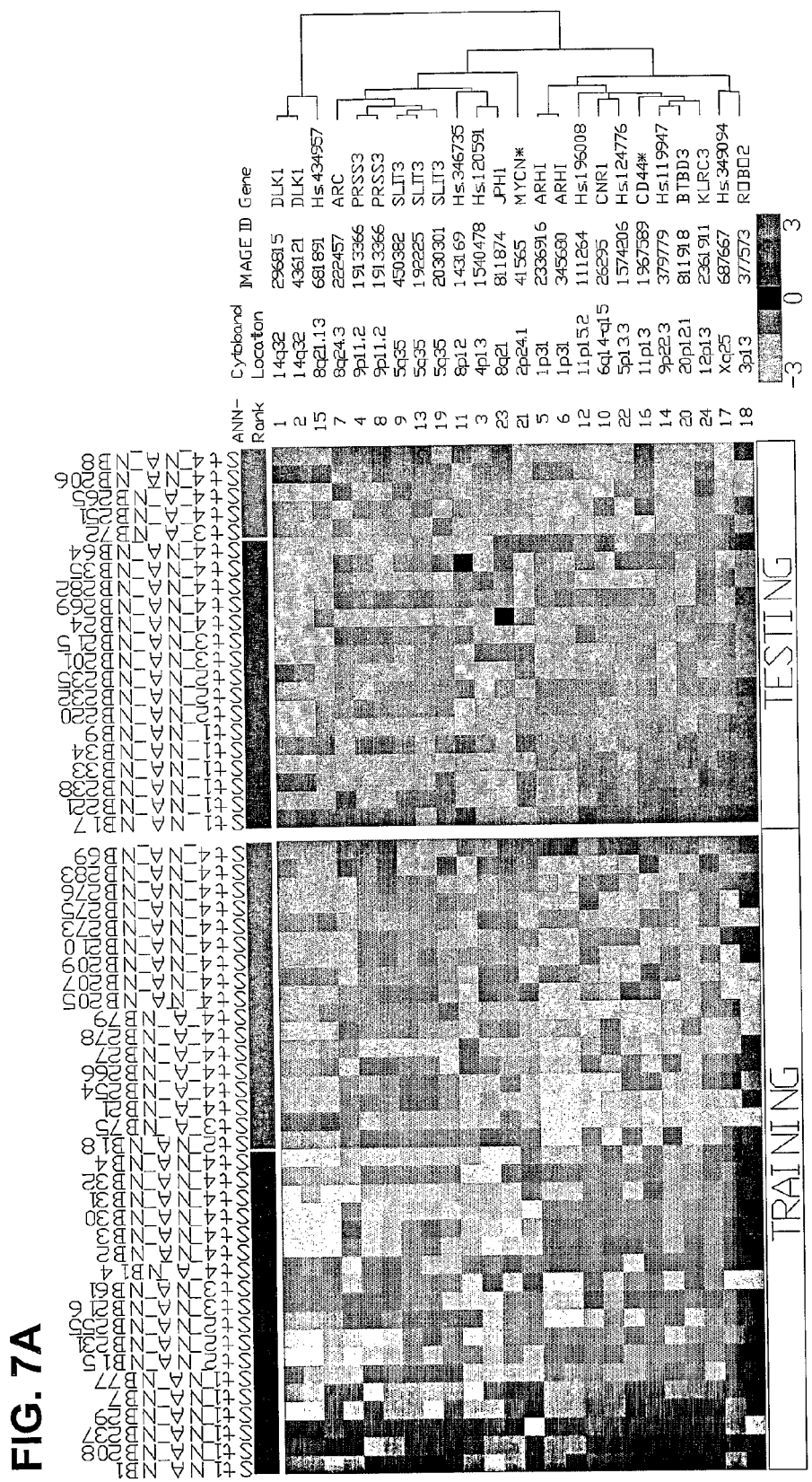
FIGS. 7A, and B depict (A) the expression level of each gene was logged (base 2) and mean-centered, and represented by pseudo-colors according to the scale shown on the bottom right. A red color corresponds to up regulation, and a green color corresponds to down regulation as compared to the mean. The data presented in this figure is also shown in Table 9A, B, C and upregulation and down regulation of the gene in poor outcome patients is shown in Table 3. On the right are the ANN-ranked order, chromosomal location, IMAGE Ids, gene symbols and the hierarchical clustering dendrogram. The second and fourth bars below the sample labels mark poor-outcome patients, and the first and third bars below the sample labels mark good-outcome patients. Asterisks indicate genes that have been previously reported to be associated with NB prognosis; and (B) Differentially expressed genes in good- and poor-prognostic groups. Box and whisker plots of the mean centered expression levels of the 12 known genes identified in this study. The boxes represent the upper and lower quartiles of the data. The black horizontal line within the box denotes the median. The whiskers extending above and below the box are fixed at 1.5 times the inter-quartile range (IQR). Outliers that fall outside the whiskers of the box are plotted as circles with a dot inside.

An analysis of 56 neuroblastoma samples from patients (34 patients alive and 22 deceased as shown in FIG. 4B) is conducted. The samples are divided into two groups: 35 NB samples selected for training (18 samples from patients that were alive and 17 from patients that were deceased) and 21 NB samples reserved for testing (16 samples from patients that were alive and 5 samples from patients that were deceased). The first set of samples are used to train ANNs and are subjected to gene minimization to identify 19 unique genes or polynucleotides. The 19 genes were then used to train ANNs and the set of 21 samples are analyzed using the trained ANNs and the outcome of these patients as predicted with a score of 0 for good outcome and a score of 1 for poor outcome. In an embodiment, the set of genes useful for prognosis of neuroblastoma is summarized as shown in FIG. 7A and Tables 2 and 3.

B. Compositions, Methods, and Devices for Predicting the Clinical Outcome of Patients with Neuroblastoma.

Methods

Neuroblastoma is the most common solid extracranial tumor of childhood and is derived from the sympathetic nervous system. Patients in North America are currently stratified by the Children's Oncology Group into high, intermediate, and low risk based on age, tumor staging, Shimada Histology, MYCN amplification, and DNA ploidy (Brodeur, et al., Neuroblastoma. In: PA Pizzo and DG Poplack, editors, Principles and practice of pediatric oncology, 4th ed. Philadelphia: Lippincott-Raven, pp. 895-937 (2002)). Patients<1 year of age or with lower stage diseases (International Neuroblastoma Staging System stages 1 and 2) usually have better outcome than older patients or those with advanced stage diseases (International Neuroblastoma Staging System stages 3 and 4). Certain consistent cytogenetic changes, including gain of 2p24 and 17q and loss of heterozygosity at 1p36 have been associated with a more aggressive phenotype (Schwab et al., *Lancet Oncol.*, 4:472-480 (2003); Westermann et al., *Cancer Lett.*, 184:127-147 (2002)). The MYCN gene is amplified in ~22% of all neuroblastoma patients (Brodeur, *Nat. Rev. Cancer*, 3:203-216 (2003)) and is an independent predictor for poor prognosis, especially for patients>1 year of age. Although other genes, such as TRKA, TRKB, hTERT, BCL-2, caspases, and FYN (Brodeur, *Nat. Rev. Cancer*, 3:203-216 (2003); Berwanger et al., *Cancer Cell*, 2:377-386 (2002)) have been associated with neuroblastoma prognosis, they all lack the predictive power of MYCN and are not used currently in clinical practice.

High-risk patients compose ~50% of all neuroblastoma cases; however, despite significant improvement in the therapy of neuroblastoma using neoadjuvant chemotherapy, surgery, and radiation, the death rate for these patients remains at 70% (Pearson et al., In: G M Brodeur, T. Sawada, Y. Tsuchida, P A Voute, editors. Neuroblastoma, 1st ed. Amsterdam, The Netherlands: Elsevier Science, p. 555 (2000)). Although the Children's Oncology Group risk stratification has been carefully developed to take into account the above risk factors, it is primarily used to guide therapy and does not predict which individual patients will be cured from the disease.

Gene expression profiles from cDNA microarrays are described herein and are useful to predict the outcome and identify a prognostic gene set in patients with neuroblastoma using artificial neural networks. A prediction of the outcome of the patient having neuroblastoma will assist the physicians in selecting an appropriate treatment regimen. For those patients whose gene expression profile indicates a poor outcome, more aggressive treatment may be warranted. For those patients whose gene expression profile indicates a good outcome, less aggressive treatment may be warranted. The identification of the set of genes useful for prognosis will provide for microarray assays or other clinical assays useful in predicting outcome of patients having neuroblastoma. Once the prognostic profile is identified as described herein, the prediction of outcome may be accomplished without the use of artificial neural network analysis.

Figure 7B:
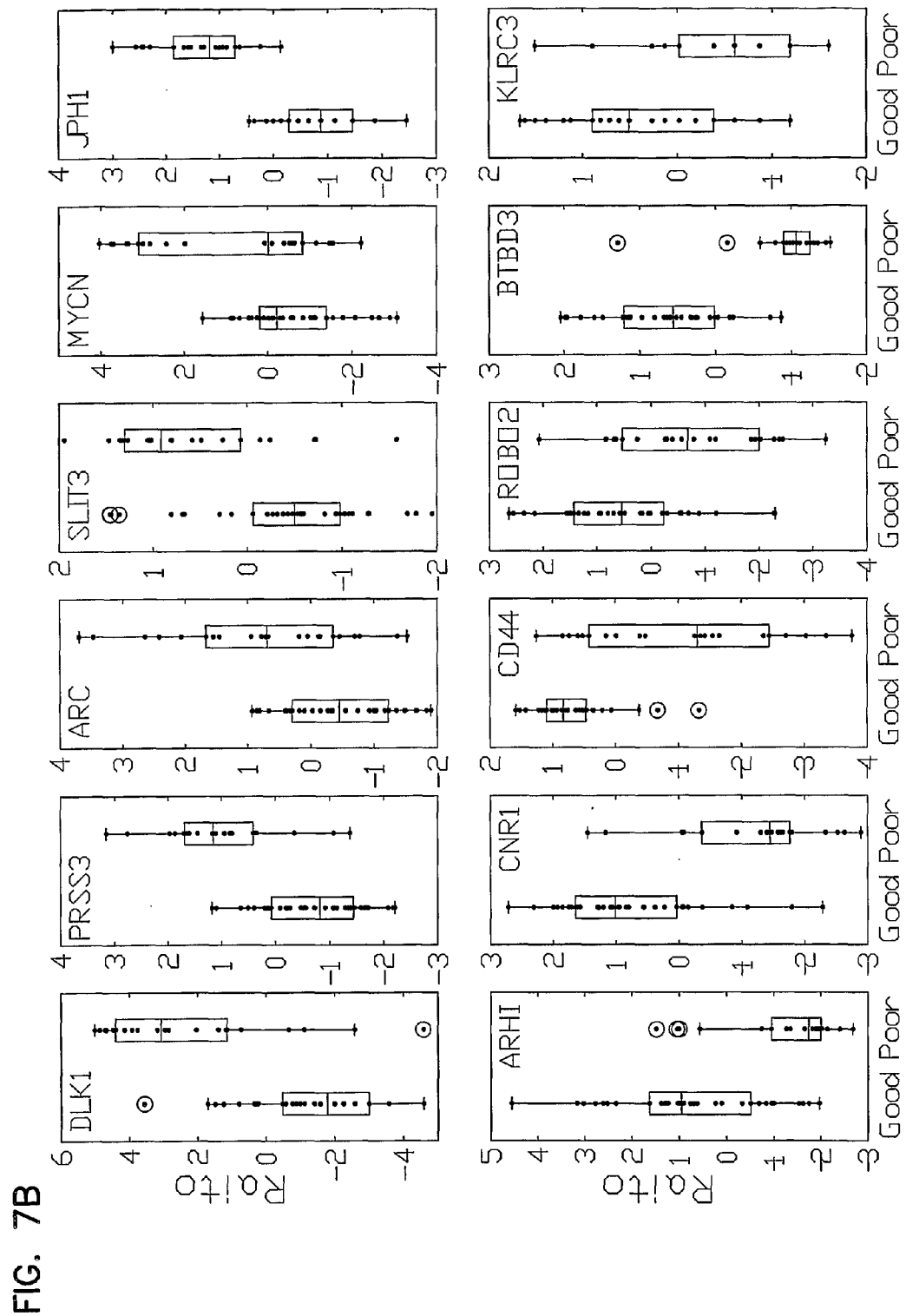

One aspect of the invention, provides for a method for predicting the outcome of a patient or subject having neuroblastoma comprising detecting an increase in expression of at least one gene selected from the group consisting of DLK1, PRSS3, SL1T3 and mixtures thereof in a neuroblastoma cell from the patient, wherein the increase in expression is indicative of poor outcome. Optionally, the expression levels of at least one gene or polynucleotide are compared to that of a patient with a good outcome and/or poor outcome. For example, if the expression level is upregulated in comparison to expression levels in a patient with good outcome, then it is likely the patient will have a poor outcome. Poor outcome refers to patient that is likely to die, die in a much shorter time, and/or has died. Good outcome refers to a patient that is still alive and/or is in remission (no progression or relapse) for at least 3 years. In some embodiments, an increase in expression is determined by detecting mRNA expression as compared to a nonneuroblastoma cell or as compared to expression in a cell from a neuroblastoma tumor from a subject with a good and/or poor outcome. Examples of the expression levels of prognostic genes identified herein is shown in FIGS. 7A, 7B, Table 3 and/or Tables 9A, B and C. Upregulation (P+) or down regulation (P−) of genes in poor outcome patients is shown in Table 3. Typically genes upregulated in poor outcome patients are not up or down, or are downregulated in good outcome patients. Typically genes downregulated in poor outcome patients are not up or down, or are upregulated in good outcome patients. Predictions using expression profile data can be made utilizing standard statistical techniques as described herein, such as Kaplan Meier methods.

In some embodiments, reference RNA is included in the microassay analysis, such reference RNA can be obtained from a nonneuroblastoma cell such as from a mixture of other type of cell lines. In addition, a control may be included for detecting expression of at least one housekeeping gene, preferably 5-10 housekeeping genes. In some embodiments, an increase in mRNA expression is detected using a microarray, hybridization assay or PCR assays including real time PCR. In other embodiments, expression of at least one of the genes is detected by measuring the concentration of the protein in a biological sample using standard methodologies such as ELISA, immuno PCR, and other like assays.

Multiple clones may provide for detection of any one of the genes identified herein as prognostic for neuroblastoma. See, for example, FIG. 7A or Table 3, showing several clones detecting SLIT3 and other genes. The polynucleotide (or its complement) and amino acid sequence associated with an Image ID No. and/or Accession No. can be readily identified in publicly available databases such as source.stanford.edu/cgi-bin/source/sourceSearch or the NCBI database for UnigeneIDs. The polynucleotides and/or genes and polypeptides are preferably human. In addition, cDNA libraries, including human cDNA libraries or DNA libraries; are commercially available and provide a source of the sequences for the genes and/or polynucleotides identified herein. (See, for example, Invitrogen's website.) Representative polynucleotide sequences for each gene are provided in the sequence listing which forms a part of this disclosure, In some embodiments, the gene for DLK1 comprises a polynucleotide sequence of Image ID NO: 296815 or Image ID NO: 436121. The DLK1 gene may also comprises a polynucleotide sequence of SEQ ID NO:1. In some embodiments, the gene for SLIT3 comprise a nucleotide sequence of Image ID NO: 450382, or Image ID NO: 192225, or Image ID NO: 2030301. The SLIT3 gene may also comprise a polynucleotide sequence of SEQ ID NO:6. In some embodiments, the PRSS3 gene comprises a polynucleotide sequence of Image ID NO: 1913366. The PRSS3 gene may also comprise a polynucleotide sequence of SEQ ID NO:3.

In some embodiments, DLK1 comprises an amino acid sequence as provided in Accession No. NP_003827 (gI: 21361080) and having a sequence of SEQ ID NO:254. In an embodiment, PRSS3 comprises an amino acid sequence of Accession No. NP_002762 (gi|21536452) having a sequence of SEQ ID NO:255. In an embodiment, SLIT3 comprises an amino acid sequence of Accession No. NP_003053 (gi|11321571) and having a sequence of SEQ ID NO:256. Other secreted polypeptides include PRSS12, GAL, and IL-7. The polypeptides may be useful to develop antibodies or other reagents that may be useful to detect an increase of the polypeptide in a biological sample.

In some embodiments of the methods, the expression of at least two of the genes, preferably at least three of the genes is detected. In a further embodiment, the method may further comprise detecting an up-regulation of expression of MYCN and/or a downregulation of expression of CD44. In some embodiments, the gene for MYCN comprises the sequence of Image ID NO: 41565. The gene for MYCN may also comprise a polynucleotide sequence of SEQ ID NO:16. In some embodiments, the gene for CD44 comprises the sequence of Image ID NO: 1967589. The gene for CD44 may also comprise a polynucleotide sequence of SEQ ID NO:12.

The invention also includes another method for predicting the outcome of a patient or subject having neuroblastoma comprising detecting a change in expression of at least one gene or polynucleotide or all genes or polynucleotides selected from the group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof in a neuroblastoma cell from the patient, wherein the expression profile or change in expression of the gene or polynucleotide is indicative of the outcome of the patient. In some embodiments, the method further comprises detecting the expression of MYCN and/or CD44. In some embodiments, at least one of the genes or polynucleotides selected from the group consisting of DLK1, PRSS3, ARC, SLIT3, JPH1, Hs. 434957, Hs. 346735, Hs. 120591, and mixtures thereof, is upregulated indicating that the outcome of the patient is poor. In other embodiments, at least one gene or polynucleotide selected from the group consisting of ARH1, CNR1, ROBO2, BTBD3, KLRC3, Hs. 196008, Hs. 124776, Hs. 119947, Hs. 349094, and mixtures thereof, is downregulated indicating that the outcome of the patient is poor. Optionally, the expression levels of at least one gene or polynucleotide are compared to that of a patient with a good outcome and/or poor outcome. For example, if the expression level of the gene is upregulated or down regulated in comparison to expression levels in a patient with good outcome, then it is likely the patient will have a poor outcome.

In some embodiments, the genes or polynucleotides comprises a sequence of the Image Id Nos as follows: a gene DLK1 comprises a polynucleotide sequence of Image ID NO: 296815 or 436121; a gene PRSS3 comprises a polynucleotide sequence of Image ID NO: 1913366; a gene ARC comprises a polynucleotide sequence of Image ID NO: 222457; a gene SLIT3 comprises a polynucleotide sequence of Image ID NO: 450382, or Image ID NO: 192225, or Image ID NO: 2030301; a gene JPH1 of Image ID NO: 811874; a gene ARH1 comprises a polynucleotide sequence of Image ID NO: 2336916; a gene CNR1 comprises a polynucleotide sequence of Image ID NO: 26295; a gene ROBO2 comprises a polynucleotide sequence of Image ID NO: 377573; a gene BTBD3 comprises a polynucleotide sequence of Image ID NO: 811918; a gene KLRC3 comprises a polynucleotide sequence of Image ID NO: 2361911; Hs. 434957 comprises a polynucleotide sequence of Image ID NO: 681891; Hs. 346735 comprises a polynucleotide sequence of Image ID NO: 143169; Hs. 120591 comprises a polynucleotide sequence of Image ID NO: 1540478; Hs. 196008 comprises a polynucleotide sequence of Image ID NO: 111264; Hs.

124776 comprises a polynucleotide sequence of Image ID NO: 1574206; Hs. 119947 comprises a polynucleotide sequence of Image ID NO: 379779; and Hs. 349094 comprises a polynucleotide sequence of Image ID NO: 687667. SEQ ID NOs corresponding to a representative polynucleotide sequence for each gene or polynucleotide are provided in Tables 2 and 3. Sequences corresponding to the SEQ ID NOs are provided in the sequence listing provided herein. The sequence listing forms a part of this disclosure and the contents of the sequence listing are hereby incorporated herein.

In some embodiments of the methods, the expression of at least two of the genes or polynucleotides, preferably at least three, at least four, at least five, at least six, at least seven, at least eight, at least nine, at least ten, at least eleven, at least twelve, at least thirteen, at least fourteen, at least fifteen, at least sixteen, at least seventeen, at least eighteen or all of the genes of Table 2 are detected. In a further embodiment, the method may further comprise detecting an up-regulation of expression of MYCN and/or a downregulation of expression of CD44. In some embodiments, the gene for MYCN comprises the sequence Image ID NO: 41565. The gene for MYCN may also comprise a polynucleotide sequence of SEQ ID NO:16. In some embodiments, the gene for CD44 comprises the sequence of Image ID NO: 1967589. The gene for CD44 may also comprise a polynucleotide sequence of SEQ ID NO:12.

In some embodiments of the methods, the patient having neuroblastoma is classified as high risk according to the criteria of the Children's Oncology group. This criteria has been described in Brodeur et al. cited supra. In other embodiments, the tumor from the patient having neuroblastoma does not have an amplification of MYCN. The methods of the invention are useful to predict the outcome of high risk patients including those patients that do not have an amplification of MYCN.

In some embodiments, the methods may further comprise detecting at least one other gene or polynucleotide identified in Table 3. The methods may involve successively detecting each of the next 10 top ranked genes or polynucleotides as provided in Table 3 up to and including detecting all 250 genes or polynucleotides identified in Table 3. For example, the methods for predicting outcome of a patient having neuroblastoma may further comprise detecting the expression levels of at least the top twenty to thirty ranked genes, the top thirty to forty top ranked genes etc. or combination thereof. In Tables 3 and 9A, B, C, the expression profile of the genes as upregulated or downregulated in neuroblastoma cells is shown.

Another aspect of the invention provides methods for selecting a treatment for patients having neuroblastoma comprising a) determining a gene expression profile of the neuroblastoma tumor cell of at least one gene or polynucleotide selected from group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof; and b) predicting whether the outcome of the patient is poor or good based on the expression profile; c) optionally, designing a more aggressive treatment for the patient if the predicted outcome for the patient is poor or designing a less aggressive treatment if the predicted outcome is good. Predicting whether the outcome is good or bad can be determined by comparing the expression profile to the expression profile of a patient with a good outcome and/or the expression of profile of a patient with poor outcome. For example, if the expression level is upregulated or down regulated in comparison to expression levels in a patient with good outcome, then it is likely the patient will have a poor outcome. Standard statistical methods may be employed to conduct the comparison, including Kaplan Meier methods. An example of the expression profile is provided herein in FIG. 7B, Table 3, and 9A, B, C. In some embodiments, designing a more aggressive treatment for patients predicted to have a poor outcome comprises using at least one treatment that is considered experimental, especially for those treatments for which clinical trials have indicated a positive response. In some embodiments, designing a treatment for a patient with predicted good outcome comprises selecting at least one treatment that has less risk of toxicity or death associated with treatment, such as decreases in the dosage or amounts of chemotherapeutic agent.

The genes given in table 2 and 3 below can also be used to make up a selection or set of genes for predicting the outcome of a patient with neuroblastoma (NB). Gene selections such as these can be used to predict the clinical outcome of a patient with neuroblastoma as discussed above.

TABLE 2

Top 19 Ranked Genes for Prediction of Neuroblastoma Clinical Outcome

| Rank | Gene | SEQ ID NO. | Title of Gene |
|---|---|---|---|
| 1 | DLK1 | SEQ ID NO. 1 | delta-like 1 homolog |
| 2 | EST | SEQ ID NO. 2 | *Homo sapiens* cDNA FLJ35632 fis, clone SPLEN2011678 |
| 3 | PRSS3 | SEQ ID NO. 3 | protease, serine, 3 (mesotrypsin) |
| 4 | ARHI | SEQ ID NO. 4 | ras homolog gene family, member 1 |
| 5 | ARC | SEQ ID NO. 5 | activity-regulated cytoskeleton-associated protein |
| 6 | SLIT3 | SEQ ID NO. 6 | slit homolog 3 (*Drospholia*) |
| 7 | CNR1 | SEQ ID NO. 7 | cannabinoid receptor 1 (brain) |
| 8 | EST | SEQ ID NO. 8 | *Homo sapiens*, clone IMAGE: 3881549, mRNA |
| 9 | EST | SEQ ID NO. 9 | *Homo sapiens*, cDNA FLJ11723 fis, clone HEMBA 1005314 |
| 10 | FLJ25461 | SEQ ID NO. 10 | hypothetical protein FLJ25461 |
| 11 | EST | SEQ ID NO. 11 | *Homo sapiens*, clone IMAGE: 3618365, mRNA |
| 12 | CD44 | SEQ ID NO. 12 | CD44 antigen (homing function and Indian blood group system) |
| 13 | EST | SEQ ID NO. 13 | *Homo sapiens* cDNA clone IMage: 4811759, partial cds |
| 14 | ROBO2 | SEQ ID NO. 14 | roundabout, axon guidance receptor, homolog 2 (*Drosophila*) |
| 15 | BTBD3 | SEQ ID NO. 15 | BTB (POZ) domain containing 3 |
| 16 | MYCN | SEQ ID NO. 16 | v-myc myelocytomatosis viral related oncogene, neuroblastoma derived (avian) |
| 17 | EST | SEQ ID NO. 17 | *Homo sapiens* mRNA; cDNA DKFZp564N1116 (from clone DKFZp564N1116) |
| 18 | JPH1 | SEQ ID NO. 18 | junctophilin 1 |
| 19 | KLRC3 | SEQ ID NO. 19 | killer cell lectin-like receptor subfamily C, member 3 |

TABLE 3

Top 250 Ranked Genes for Prediction of Neuroblastoma Clinical Outcome

| Rank | Gene | SEQ ID NO. | Plate Position | Direction | Clone ID | UG_ID |
|---|---|---|---|---|---|---|
| 1. | DLK1 | SEQ ID NO. 1 | HsKG60E8 | P+ | 296815 | Hs.169228 |
| 2. | EST | SEQ ID NO. 2 | R43273g9 | P+ | 1540478 | Hs.120591 |
| 3. | PRSS3 | SEQ ID NO. 3 | R43297f11 | P+ | 1913366 | Hs.435699 |
| 4. | ARHI | SEQ ID NO. 4 | HsKG99e8 | P− | 2336916 | Hs.194695 |
| 5. | ARC | SEQ ID NO. 5 | HsKG85h1 | P+ | 222457 | Hs.40888 |
| 6. | SLIT3 | SEQ ID NO. 6 | HsKG54B2 | P+ | 450382 | Hs.484063 |
| 7. | CNR1 | SEQ ID NO. 7 | HsKG14D12 | P− | 26295 | Hs.75110 |
| 8. | EST | SEQ ID NO. 8 | R4353e2 | P+ | 143169 | Hs.346735 |
| 9. | EST | SEQ ID NO. 9 | R4353a9 | P− | 111264 | Hs.196008 |
| 10. | FLJ25461 | SEQ ID NO. 10 | R43251f2 | P− | 379779 | Hs.119947 |
| 11. | EST | SEQ ID NO. 11 | R43175b4 | P+ | 681891 | Hs.434957 |
| 12. | CD44 | SEQ ID NO. 12 | CD1C7 | P− | 1967589 | Hs.306278 |
| 13. | EST | SEQ ID NO. 13 | R43163f10 | P− | 687667 | Hs.349094 |
| 14. | ROBO2 | SEQ ID NO. 14 | R43234e10 | P− | 377573 | Hs.31141 |
| 15. | BTBD3 | SEQ ID NO. 15 | FHskG5F10 | P− | 811918 | Hs.7935 |
| 16. | MYCN | SEQ ID NO. 16 | HsKG20G3 | P+ | 41565 | Hs.25960 |
| 17. | EST | SEQ ID NO. 17 | R43277g5 | P− | 1574206 | Hs.124776 |
| 18. | JPH1 | SEQ ID NO. 18 | R43167a6 | P+ | 811874 | Hs.293836 |
| 19. | KLRC3 | SEQ ID NO. 19 | HsKG99g7 | P− | 2361911 | Hs.74082 |
| 20. | EST | SEQ ID NO. 20 | R43175a2 | P− | 666469 | Hs.444181 |
| 21. | RET | SEQ ID NO. 21 | HsKG97c4 | P+ | 1516955 | Hs.350321 |
| 22. | CRABP1 | SEQ ID NO. 22 | HsKG32F5 | P+ | 809694 | Hs.346950 |
| 23. | ECEL 1 | SEQ ID NO. 23 | HsKG88h8 | P− | 37986 | Hs.26880 |
| 24. | LOC283120 | SEQ ID NO. 24 | R4383a3 | P+ | 428721 | Hs.415722 |
| 25. | HMGA2 | SEQ ID NO. 25 | R43158f12 | P− | 42803 | Hs.6421 |
| 26. | SNYPO2 | SEQ ID NO. 26 | R43199g2 | P+ | 284383 | Hs.24192 |
| 27. | LOC163782 | SEQ ID NO. 27 | R4327c6 | P− | 246035 | Hs.78026 |
| 28. | VSNL1 | SEQ ID NO. 28 | HsKG2H2 | P− | 210575 | Hs.2288 |
| 29. | HS3ST4 | SEQ ID NO. 29 | HsKG92e9 | P− | 1569187 | Hs.8040 |
| 30. | AKR1C1 | SEQ ID NO. 30 | HsKG5H3 | P− | 196992 | Hs.295131 |
| 31. | EST | SEQ ID NO. 31 | R43234b6 | P+ | 345656 | Hs.83623 |
| 32. | GPR22 | SEQ ID NO. 32 | HsKG77B6 | P+ | 42685 | Hs.432557 |
| 33. | EST | SEQ ID NO. 33 | HsKG91b12 | P+ | 486278 | Hs.502418 |
| 34. | EST | SEQ ID NO. 34 | R43241e9 | P− | 375741 | Hs.144627 |
| 35. | CCNA1 | SEQ ID NO. 35 | HsKG64C12 | P+ | 377799 | Hs.417050 |
| 36. | PKIB | SEQ ID NO. 36 | R43335a1 | P− | 26883 | Hs.363171 |
| 37. | EST | SEQ ID NO. 37 | R43248b12 | P− | 174685 | Hs.31564 |
| 38. | GAL | SEQ ID NO. 38 | R43332c7 | P+ | 2237353 | Hs.278959 |
| 39. | EST | SEQ ID NO. 39 | R43386f8 | P+ | 1836760 | Hs.459132 |
| 40. | LOC221303 | SEQ ID NO. 40 | R43276g5 | P+ | 1563968 | Hs.126712 |
| 41. | EST | SEQ ID NO. 41 | HsKG93b5 | P− | 725709 | Hs.367767 |
| 42. | EST | SEQ ID NO. 42 | HsKG68H9 | P+ | 145310 | Hs.22404 |
| 43. | BMP7 | SEQ ID NO. 43 | R4366e1 | P+ | 366887 | Hs.170195 |
| 44. | SLC30A3 | SEQ ID NO. 44 | R43145b2 | P+ | 744391 | Hs.111967 |
| 45. | FLJ10539 | SEQ ID NO. 45 | R43136h12 | P− | 595162 | Hs.301198 |
| 46. | AMIGO2 | SEQ ID NO. 46 | R43244f2 | P− | 253884 | Hs.121520 |
| 47. | AKR1C2 | SEQ ID NO. 47 | HsKG101e7 | P− | 2449395 | Hs.201967 |
| 48. | MGP | SEQ ID NO. 48 | HsKG12G8 | P− | 590264 | Hs.365706 |
| 49. | PCSK1 | SEQ ID NO. 49 | HsKG3H7 | P− | 31072 | Hs.78977 |
| 50. | HK2 | SEQ ID NO. 50 | HsKG56B8 | P+ | 1637282 | Hs.406266 |
| 51. | EST | SEQ ID NO. 51 | R43187d12 | P+ | 136502 | Hs.409873 |
| 52. | EST | SEQ ID NO. 52 | HsKG100f8 | P+ | 2410555 | Hs.460974 |
| 53. | IL7 | SEQ ID NO. 53 | R43331b3 | P− | 2090264 | Hs.72927 |
| 54. | PRSS12 | SEQ ID NO. 54 | HsKG70C9 | P+ | 1553054 | Hs.512796 |
| 55. | GABARAPL1 | SEQ ID NO. 55 | HsKG50B10 | P− | 81409 | Hs.336429 |
| 56. | DEFB129 | SEQ ID NO. 56 | R43145c2 | P+ | 743161 | Hs.112087 |
| 57. | NAV3 | SEQ ID NO. 57 | R43251d10 | P− | 379484 | Hs.306322 |
| 58. | RAB3B | SEQ ID NO. 58 | R43163f3 | P− | 687297 | Hs.123072 |
| 59. | KRT6B | SEQ ID NO. 59 | R43266g2 | P− | 1486118 | Hs.432677 |
| 60. | BEX1 | SEQ ID NO. 60 | R4337a1 | P+ | 341706 | Hs.334370 |
| 61. | EST | SEQ ID NO. 61 | R4343a1 | P+ | 140210 | Hs.155795 |
| 62. | EST | SEQ ID NO. 62 | R43345h11 | P− | 1558233 | Hs.7413 |
| 63. | SCYL1 | SEQ ID NO. 63 | R4382f12 | P− | 770697 | Hs.238839 |
| 64. | EST | SEQ ID NO. 64 | R43100e4 | P− | 51993 | Hs.7047 |
| 65. | RYR2 | SEQ ID NO. 65 | HsKG43H4 | P− | 53099 | Hs.90821 |
| 66. | LRBA | SEQ ID NO. 66 | HsKG23C10 | P+ | 376516 | Hs.209846 |
| 67. | CSPG3 | SEQ ID NO. 67 | HsKG56F5 | P+ | 1609966 | Hs.169047 |
| 68. | EST | SEQ ID NO. 68 | R43405e1 | P− | 1880885 | Hs.129977 |
| 69. | MMP12 | SEQ ID NO. 69 | HsKG4D7 | P+ | 196612 | Hs.1695 |
| 70. | CHRNA1 | SEQ ID NO. 70 | HsKG77E8 | P− | 347370 | Hs.434419 |
| 71. | EST | SEQ ID NO. 71 | R43340e10 | P− | 1518228 | Hs.130061 |
| 72. | EST | SEQ ID NO. 72 | R43105h8 | P− | 52329 | Hs.470493 |
| 73. | HNRPH1 | SEQ ID NO. 73 | R4344f7 | P+ | 195127 | Hs.202166 |
| 74. | LOC113251 | SEQ ID NO. 74 | R43399f5 | P− | 1856516 | Hs.26613 |
| 75. | EST | SEQ ID NO. 75 | R4337f2 | P− | 137793 | Hs.17962 |

TABLE 3-continued

Top 250 Ranked Genes for Prediction of Neuroblastoma Clinical Outcome

| | | | | | | |
|---|---|---|---|---|---|---|
| 76. | PAG | SEQ ID NO. 76 | R4381f12 | P− | 282779 | Hs.266175 |
| 77. | PROK2 | SEQ ID NO. 77 | R43162g10 | P− | 53319 | Hs.13305 |
| 78. | HS6ST1 | SEQ ID NO. 78 | HsKG69H10 | P+ | 969769 | Hs.512841 |
| 79. | EST | SEQ ID NO. 79 | R43405c7 | P− | 1880352 | Hs.104419 |
| 80. | PCDH9 | SEQ ID NO. 80 | R4376b12 | P− | 284714 | Hs.492696 |
| 81. | EST | SEQ ID NO. 81 | R43265d8 | P+ | 1469434 | Hs.458730 |
| 82. | EST | SEQ ID NO. 82 | R43279d1 | P− | 1585344 | Hs.121518 |
| 83. | GLDC | SEQ ID NO. 83 | HsKG5C5 | P+ | 248261 | Hs.149156 |
| 84. | ADRB2 | SEQ ID NO. 84 | HsKG15A5 | P− | 241489 | Hs.2551 |
| 85. | ICSBP1 | SEQ ID NO. 85 | R43331c7 | P+ | 2107378 | Hs.14453 |
| 86. | CD48 | SEQ ID NO. 86 | CD1C6 | | 1671476 | Hs.901 |
| 87. | EST | SEQ ID NO. 87 | R43184a7 | P− | 191787 | Hs.13640 |
| 88. | DYRK1B | SEQ ID NO. 88 | R43274g9 | P+ | 1553469 | Hs.130988 |
| 89. | KLRC1 | SEQ ID NO. 89 | HsKG64E8 | P− | 1525029 | Hs.512576 |
| 90. | EST | SEQ ID NO. 90 | HsKG87b11 | P− | 625786 | Hs.380933 |
| 91. | EST | SEQ ID NO. 91 | R43199b1 | P+ | 281517 | Hs.388565 |
| 92. | EST | SEQ ID NO. 92 | R4337c5 | P+ | 120162 | Hs.406351 |
| 93. | MOXD1 | SEQ ID NO. 93 | FHskG5F5 | P− | 767181 | Hs.6909 |
| 94. | EST | SEQ ID NO. 94 | R43126a6 | P+ | 304927 | Hs.44380 |
| 95. | EST | SEQ ID NO. 95 | R43206h6 | P− | 451394 | Hs.191950 |
| 96. | GAS1 | SEQ ID NO. 96 | R4378h7 | P− | 365826 | Hs.65029 |
| 97. | COL9A2 | SEQ ID NO. 97 | R43330g9 | P− | 2019798 | Hs.418012 |
| 98. | EST | SEQ ID NO. 98 | R43146g7 | P− | 244312 | Hs.440908 |
| 99. | DRPLA | SEQ ID NO. 99 | HsKG5H6 | P− | 45291 | Hs.169488 |
| 100. | EST | SEQ ID NO. 100 | R43396h4 | P− | 1850044 | Hs.334594 |
| 101. | REPRIMO | SEQ ID NO. 101 | HsKG91d4 | P− | 1034699 | Hs.100890 |
| 102. | CACNA2D2 | SEQ ID NO. 102 | R43145a2 | P+ | 123539 | Hs.389415 |
| 103. | NEBL | SEQ ID NO. 103 | R43171d12 | P− | 796643 | Hs.5025 |
| 104. | EST | SEQ ID NO. 104 | R43174a9 | P− | 43705 | Hs.25211 |
| 105. | HLA-DQA1 | SEQ ID NO. 105 | R43305e9 | P− | 320393 | Hs.387679 |
| 106. | EDG3 | SEQ ID NO. 106 | R43199e6 | P− | 283748 | Hs.4257 |
| 107. | CPVL | SEQ ID NO. 107 | HsKG91d10 | P− | 39833 | Hs.95594 |
| 108. | FLJ32884 | SEQ ID NO. 108 | R43320b4 | P− | 383153 | Hs.375551 |
| 109. | LCP1 | SEQ ID NO. 109 | HsKG12H6 | P− | 344589 | Hs.381099 |
| 110. | EST | SEQ ID NO. 110 | R4327f11 | P− | 67033 | Hs.386104 |
| 111. | EST | SEQ ID NO. 111 | HsKG67A3 | P+ | 1461048 | Hs.443884 |
| 112. | EST | SEQ ID NO. 112 | R43411b11 | P− | 1908847 | Hs.150167 |
| 113. | EST | SEQ ID NO. 113 | R4342e12 | P− | 138974 | Hs.28367 |
| 114. | DKFZP564C152 | SEQ ID NO. 114 | R43330f1 | P+ | 1865232 | Hs.184216 |
| 115. | DMN | SEQ ID NO. 115 | FHskG6A7 | P− | 1161564 | Hs.381347 |
| 116. | GABRA5 | SEQ ID NO. 116 | HsKG99g5 | P+ | 2358925 | Hs.24969 |
| 117. | AKR1C3 | SEQ ID NO. 117 | HsKG17A1 | P− | 1473304 | Hs.78183 |
| 118. | LOC168850 | SEQ ID NO. 118 | R4376d1 | P− | 265114 | Hs.159006 |
| 119. | EST | SEQ ID NO. 119 | R43352h6 | P− | 1584099 | Hs.128216 |
| 120. | KCNQ2 | SEQ ID NO. 120 | HsKG24F10 | P+ | 179534 | Hs.4975 |
| 121. | NME5 | SEQ ID NO. 121 | HsKG51B1 | P+ | 502173 | Hs.72050 |
| 122. | EST | SEQ ID NO. 122 | R43162f7 | P− | 29841 | Hs.165570 |
| 123. | PBX1 | SEQ ID NO. 123 | R4364d4 | P− | 200656 | Hs.408222 |
| 124. | CNTNAP2 | SEQ ID NO. 124 | R43159d1 | P− | 27404 | Hs.106552 |
| 125. | EST | SEQ ID NO. 125 | R43338g9 | P− | 1503694 | Hs.406982 |
| 126. | SPON1 | SEQ ID NO. 126 | R43210e4 | P+ | 773495 | Hs.5378 |
| 127. | CDH8 | SEQ ID NO. 127 | R4334f12 | P− | 40751 | Hs.388928 |
| 128. | PRKCB1 | SEQ ID NO. 128 | HsKG3H1 | P− | 753923 | Hs.349845 |
| 129. | SLC21A11 | SEQ ID NO. 129 | R43239f7 | P− | 878698 | Hs.113657 |
| 130. | MAP4 | SEQ ID NO. 130 | R43240e6 | P− | 858672 | Hs.31095 |
| 131. | EST | SEQ ID NO. 131 | R43258f10 | P− | 855448 | Hs.162966 |
| 132. | SCN7A | SEQ ID NO. 132 | R4364h4 | P− | 795262 | Hs.406684 |
| 133. | EST | SEQ ID NO. 133 | R43102g1 | P− | 51420 | Hs.446660 |
| 134. | EST | SEQ ID NO. 134 | R43279a11 | P− | 1584398 | Hs.370168 |
| 135. | EST | SEQ ID NO. 135 | R43164h7 | P− | 754346 | Hs.34145 |
| 136. | EST | SEQ ID NO. 136 | R43367f11 | P+ | 1690886 | Hs.134687 |
| 137. | CDW52 | SEQ ID NO. 137 | HsKG100g3 | P+ | 2417330 | Hs.276770 |
| 138. | ARCB1 | SEQ ID NO. 138 | HsKG20G8 | P+ | 813256 | Hs.21330 |
| 139. | EST | SEQ ID NO. 139 | R43407f2 | P− | 1893735 | Hs.146175 |
| 140. | OST-2 | SEQ ID NO. 140 | HsKG30A7 | P+ | 897910 | Hs.136348 |
| 141. | NRXN1 | SEQ ID NO. 141 | R43344h11 | P− | 1552433 | Hs.22998 |
| 142. | ADAM22 | SEQ ID NO. 142 | R4369b7 | P+ | 284541 | Hs.256398 |
| 143. | EST | SEQ ID NO. 143 | R43243f12 | P+ | 38152 | Hs.301296 |
| 144. | TRGV9 | SEQ ID NO. 144 | R43G11B6 | P− | 281003 | Hs.407442 |
| 145. | EST | SEQ ID NO. 145 | HsKG88e11 | P+ | 840677 | Hs.377975 |
| 146. | PTPRD | SEQ ID NO. 146 | R43105e7 | P− | 47186 | Hs.323079 |
| 147. | EST | SEQ ID NO. 147 | R43237g1 | P+ | 1292654 | Hs.120364 |
| 148. | HS3ST2 | SEQ ID NO. 148 | HsKG59G11 | P+ | 1557290 | Hs.115830 |
| 149. | FGF13 | SEQ ID NO. 149 | HsKG100a7 | P− | 2385663 | Hs.6540 |
| 150. | MKI67 | SEQ ID NO. 150 | HsKG6G9 | P+ | 769513 | Hs.80976 |
| 151. | KIF12 | SEQ ID NO. 151 | R4342d12 | P− | 214205 | Hs.28149 |
| 152. | EST | SEQ ID NO. 152 | R43252h5 | P+ | 432477 | Hs.113170 |
| 153. | EST | SEQ ID NO. 153 | HsKG66G1 | P− | 306841 | Hs.449439 |

TABLE 3-continued

Top 250 Ranked Genes for Prediction of Neuroblastoma Clinical Outcome

| | | | | | | |
|---|---|---|---|---|---|---|
| 154. | EST | SEQ ID NO. 154 | HsKG3B11 | P− | 770014 | Hs.74647 |
| 155. | EST | SEQ ID NO. 155 | HsKG10E4 | P+ | 66560 | Hs.356861 |
| 156. | EST | SEQ ID NO. 156 | HsKG2B3 | P− | 267420 | Hs.510917 |
| 157. | KLIP1 | SEQ ID NO. 157 | FHskG14E3 | P+ | 782259 | Hs.38178 |
| 158. | EST | SEQ ID NO. 158 | R43272a11 | P+ | 1522487 | Hs.130183 |
| 159. | LOC157570 | SEQ ID NO. 159 | R43282h5 | P− | 1623191 | Hs.99480 |
| 160. | MAD2L1 | SEQ ID NO. 160 | HsKG28B2 | P+ | 814701 | Hs.79078 |
| 161. | EST | SEQ ID NO. 161 | R43275a2 | P− | 1554430 | Hs.388347 |
| 162. | EST | SEQ ID NO. 162 | R43160f5 | P− | 726564 | Hs.97579 |
| 163. | RGS5 | SEQ ID NO. 163 | HsKG37F3 | P− | 853809 | Hs.24950 |
| 164. | ATP2B4 | SEQ ID NO. 164 | R4376f10 | P− | 502326 | Hs.343522 |
| 165. | HMGCL | SEQ ID NO. 165 | HsKG2G7 | P− | 838366 | Hs.444925 |
| 166. | ODZ3 | SEQ ID NO. 166 | R43371a4 | P− | 1704063 | Hs.41793 |
| 167. | CHGA | SEQ ID NO. 167 | HsKG61C1 | P+ | 1585535 | Hs.124411 |
| 168. | MGC33510 | SEQ ID NO. 168 | R43238d9 | P− | 884658 | Hs.158798 |
| 169. | GAGE5 | SEQ ID NO. 169 | HsKG82H6 | P+ | 2911881 | Hs.278606 |
| 170. | SARDH | SEQ ID NO. 170 | R43402f5 | P− | 1870053 | Hs.198003 |
| 171. | EST | SEQ ID NO. 171 | R43164e6 | P− | 753982 | Hs.86538 |
| 172. | DAT1 | SEQ ID NO. 172 | R43229e6 | P− | 897262 | Hs.301914 |
| 173. | FUCA1 | SEQ ID NO. 173 | HsKG5E7 | P− | 308437 | Hs.576 |
| 174. | TM6SF2 | SEQ ID NO. 174 | R43144a9 | P+ | 342187 | Hs.367829 |
| 175. | KCNK9 | SEQ ID NO. 175 | R43229d8 | P+ | 897105 | Hs.117010 |
| 176. | ADCYAP1 | SEQ ID NO. 176 | HsKG2A3 | P− | 969568 | Hs.68137 |
| 177. | PLXNA4 | SEQ ID NO. 177 | R43230e12 | P− | 41287 | Hs.169129 |
| 178. | HLA-DMB | SEQ ID NO. 178 | HsKG1B4 | P− | 148231 | Hs.1162 |
| 179. | EST | SEQ ID NO. 179 | R43205d4 | P− | 436059 | Hs.186937 |
| 180. | EST | SEQ ID NO. 180 | R43122e6 | P− | 742685 | Hs.519270 |
| 181. | GRIN3A | SEQ ID NO. 181 | R43173e6 | P− | 42747 | Hs.283852 |
| 182. | OSBPL3 | SEQ ID NO. 182 | R43217f10 | P− | 824212 | Hs.197955 |
| 183. | ODZ4 | SEQ ID NO. 183 | FHskG5G6 | P+ | 785913 | Hs.5028 |
| 184. | EST | SEQ ID NO. 184 | R43414c5 | P− | 1930391 | Hs.182889 |
| 185. | E2F1 | SEQ ID NO. 185 | HsKG41H12 | P+ | 768260 | Hs.96055 |
| 186. | MGC16664 | SEQ ID NO. 186 | R43288h5 | P+ | 1641875 | Hs.400696 |
| 187. | HMP19 | SEQ ID NO. 187 | HsKG86h6 | P+ | 838701 | Hs.70669 |
| 188. | IL2RB | SEQ ID NO. 188 | CD1E6 | P− | 2132327 | Hs.75596 |
| 189. | TOPK | SEQ ID NO. 189 | HsKG89c5 | P+ | 785368 | Hs.104741 |
| 190. | ALDH1A1 | SEQ ID NO. 190 | HsKG15A1 | P− | 855624 | Hs.76392 |
| 191. | CED-6 | SEQ ID NO. 191 | HsKG85g6 | P+ | 782476 | Hs.107056 |
| 192. | EST | SEQ ID NO. 192 | R43159h12 | P− | 768146 | Hs.376455 |
| 193. | A2BP1 | SEQ ID NO. 193 | R43323c4 | P− | 759206 | Hs.57937 |
| 194. | LY6E | SEQ ID NO. 194 | HsKG16D12 | P+ | 1470048 | Hs.77667 |
| 195. | EST | SEQ ID NO. 195 | R43104h4 | P− | 39885 | Hs.497208 |
| 196. | EST | SEQ ID NO. 196 | R43197e12 | P− | 259884 | Hs.419170 |
| 197. | PLXNC1 | SEQ ID NO. 197 | HsKG60F10 | P− | 261834 | Hs.286229 |
| 198. | EFS | SEQ ID NO. 198 | R4365c5 | P+ | 795730 | Hs.24587 |
| 199. | ACTN2 | SEQ ID NO. 199 | R43234f4 | P− | 377812 | Hs.83672 |
| 200. | MYC | SEQ ID NO. 200 | HsKG2H7 | P− | 812965 | Hs.202453 |
| 201. | KIAA0527 | SEQ ID NO. 201 | R43313f4 | P+ | 2016891 | Hs.196647 |
| 202. | C6orf31 | SEQ ID NO. 202 | R43235b6 | P− | 436765 | Hs.301920 |
| 203. | DLL3 | SEQ ID NO. 203 | HsKG92e2 | P+ | 1469966 | Hs.127792 |
| 204. | EST | SEQ ID NO. 204 | R43363a10 | P+ | 1663168 | Hs.435132 |
| 205. | STK33 | SEQ ID NO. 205 | R43261a6 | P+ | 1416035 | Hs.148135 |
| 206. | SEMA3A | SEQ ID NO. 206 | HsKG78B10 | P− | 767055 | Hs.252451 |
| 207. | EST | SEQ ID NO. 207 | R43338f10 | P− | 1502008 | Hs.143707 |
| 208. | IGSF4 | SEQ ID NO. 208 | R43141h9 | P− | 772960 | Hs.156682 |
| 209. | CKS2 | SEQ ID NO. 209 | HsKG10C4 | P+ | 725454 | Hs.83758 |
| 210. | EST | SEQ ID NO. 210 | R43259g11 | P− | 969593 | Hs.116922 |
| 211. | EST | SEQ ID NO. 211 | R43371c12 | P+ | 1705626 | Hs.444405 |
| 212. | SIX3 | SEQ ID NO. 212 | R4371d7 | P− | 277283 | Hs.227277 |
| 213. | FLJ22002 | SEQ ID NO. 213 | R4331c9 | P− | 153779 | Hs.461485 |
| 214. | HSD17B12 | SEQ ID NO. 214 | R4377h10 | P+ | 278938 | Hs.132513 |
| 215. | HBA2 | SEQ ID NO. 215 | HsKG81G2 | P+ | 2782586 | Hs.398636 |
| 216. | CDH11 | SEQ ID NO. 216 | R43407d7 | P− | 1893136 | Hs.443435 |
| 217. | RGS9 | SEQ ID NO. 217 | R43192c4 | P− | 383501 | Hs.117149 |
| 218. | EST | SEQ ID NO. 218 | R43279a2 | P− | 1583668 | Hs.128282 |
| 219. | NCAM2 | SEQ ID NO. 219 | HsKG97f12 | P− | 1898102 | Hs.135892 |
| 220. | BIRC5 | SEQ ID NO. 220 | R4398a5 | P+ | 796694 | Hs.1578 |
| 221. | EST | SEQ ID NO. 221 | R43237b1 | P− | 462850 | Hs.444347 |
| 222. | GNG12 | SEQ ID NO. 222 | R43119c10 | P− | 265045 | Hs.8107 |
| 223. | GPIG4 | SEQ ID NO. 223 | R43359c2 | P− | 1648516 | Hs.352552 |
| 224. | EST | SEQ ID NO. 224 | R43128g4 | P+ | 299629 | Hs.49265 |
| 225. | ENPP4 | SEQ ID NO. 225 | HsKG90c5 | P+ | 281737 | Hs.54037 |
| 226. | FMNL | SEQ ID NO. 226 | R43199b3 | P+ | 281605 | Hs.100217 |
| 227. | EST | SEQ ID NO. 227 | HsKG40C4 | P− | 743230 | Hs.240443 |
| 228. | PIWIL2 | SEQ ID NO. 228 | R43138a4 | P− | 743309 | Hs.274150 |
| 229. | CLSTN1 | SEQ ID NO. 229 | R43192b10 | P− | 231718 | Hs.29665 |
| 230. | UHRF1 | SEQ ID NO. 230 | R43344e11 | P+ | 1550739 | Hs.108106 |
| 231. | EST | SEQ ID NO. 231 | R43332e10 | P− | 2253160 | Hs.89121 |

TABLE 3-continued

Top 250 Ranked Genes for Prediction of Neuroblastoma Clinical Outcome

| | | | | | | |
|---|---|---|---|---|---|---|
| 232. | SLC40A1 | SEQ ID NO. 232 | HsKG86b1 | P− | 71863 | Hs.409875 |
| 233. | CLECSF6 | SEQ ID NO. 233 | R43255b1 | P− | 454296 | Hs.115515 |
| 234. | EST | SEQ ID NO. 234 | R43271h10 | P+ | 1520938 | Hs.127505 |
| 235. | BKLHD2 | SEQ ID NO. 235 | R43111h1 | P+ | 951083 | Hs.348262 |
| 236. | EST | SEQ ID NO. 236 | R43246f2 | P− | 121182 | Hs.520888 |
| 237. | EST | SEQ ID NO. 237 | R4333e12 | P− | 67037 | Hs.282970 |
| 238. | EST | SEQ ID NO. 238 | R43405d9 | P− | 1880732 | Hs.146138 |
| 239. | SORCS1 | SEQ ID NO. 239 | R43370a4 | P− | 1701301 | Hs.348923 |
| 240. | NRP2 | SEQ ID NO. 240 | R43168g10 | P− | 823811 | Hs.368746 |
| 241. | E2-EPF | SEQ ID NO. 241 | HsKG21A11 | P+ | 810600 | Hs.462306 |
| 242. | CAST | SEQ ID NO. 242 | R43325f1 | P− | 591381 | Hs.440961 |
| 243. | KIAA1384 | SEQ ID NO. 243 | R43359c10 | P− | 1649134 | Hs.88442 |
| 244. | KIAA0644 | SEQ ID NO. 244 | R43332g4 | P− | 2273304 | Hs.21572 |
| 245. | HLA-DRB3 | SEQ ID NO. 245 | HsKG12H2 | P− | 855547 | Hs.308026 |
| 246. | PMP22 | SEQ ID NO. 246 | R43247g12 | P− | 162310 | Hs.372031 |
| 247. | DJ79P11.1 | SEQ ID NO. 247 | R4365h1 | P+ | 810367 | Hs.398989 |
| 248. | SOX5 | SEQ ID NO. 248 | HsKG99e11 | P− | 2338834 | Hs.87224 |
| 249. | CD3E | SEQ ID NO. 249 | HsKG61E1 | P+ | 1536968 | Hs.3003 |
| 250. | EST | SEQ ID NO. 250 | R4327e11 | P− | 240945 | Hs.445357 |

| Rank | Accession | Accession | Title of Gene |
|---|---|---|---|
| 1. | N74203 gi\|1231488 | NM_003836 gi\|34147651 | delta-like 1 homolog |
| 2. | AA928113 gi\|3077269 | AK092951 gi\|21751664 | *Homo sapiens* cDNA FLJ35632 fis, clone SPLEN2011678 |
| 3. | AI308916 gi\|4003787 | NM_002771 gi\|21536451 | protease, serine, 3 (mesotrypsin) |
| 4. | AI692753 gi\|4970093 | NM_004675 gi\|58530880 | ras homolog gene family, member 1 |
| 5. | H86117 gi\|1067696 | NM_015193 gi\|56676395 | activity-regulated cytoskeleton-associated protein |
| 6. | AA703652 gi\|2713570 | NM_003062 gi\|11321570 | slit homolog 3 (*Drosophila*) |
| 7. | R20626 gi\|775407 | NM_016083 gi\|38683843 | cannabinoid receptor 1 (brain) |
| 8. | R73759 gi\|848129 | BC012900 gi\|15277677 | *Homo sapiens*, clone IMAGE: 3881549, mRNA |
| 9. | T84084 gi\|712372 | AK021785 gi\|10433040 | *Homo sapiens*, cDNA FLJ11723 fis, clone HEMBA 1005314 |
| 10. | AA706038 gi\|2715956 | NM_144966 gi\|56549657 | hypothetical protein FLJ25461/FREM1 |
| 11. | AA256176 gi\|1891715 | BC004287 gi\|13279127 | *Homo sapiens*, clone IMAGE: 3618365, mRNA |
| 12. | AI368364 gi\|4147117 | NM_000610 gi\|48255934 | CD44 antigen (homing function and Indian blood group system) |
| 13. | AA235370 gi\|1859808 | NM_002351 gi\|4506922\| | *Homo sapiens* cDNA clone IMage: 4811759, partial cds |
| 14. | AA055534 gi\|1547891 | BX648828 gi\|34367993 | roundabout, axon guidance receptor, homolog 2 (*Drosophila*) |
| 15. | AA454990 gi\|2177766 | NM_014962 gi\|31317210 | BTB (POZ) domain containing 3 |
| 16. | R52824 gi\|814726 | NM_005378 gi\|62750358 | v-myc myelocytomatosis viral related oncogene, neuroblastoma derived (avian) |
| 17. | AA938345 gi\|3096456 | AL049227 gi\|4499957 | *Homo sapiens* mRNA; cDNA DKFZp564N1116 (from clone DKFZp564N1116) |
| 18. | AA454632 gi\|2177408 | NM_020647 gi\|61676191 | junctophilin 1 |
| 19. | AI810168 gi\|5396734 | | killer cell lectin-like receptor subfamily C, member 3 |
| 20. | AA232953 gi\|1855945 | BM721099 gi\|19040795 | *Homo sapiens* LOC376510 (LOC376510), mRNA |
| 21. | AA903339 gi\|3038462 | NM_020630 gi\|50593520 | ret proto-oncogene (multiple endocrine neoplasia and medullary thyroid carcinoma 1, Hirschsprung disease) |
| 22. | AA454702 gi\|2177478 | NM_004378 gi\|4758051 | cellular retinoic acid binding protein 1 |
| 23. | R61395 gi\|832090 | NM_004826 gi\|4758231 | endothelin converting enzyme-like 1 |
| 24. | AA004638 gi\|1448175 | BC040073 gi\|25455647 | hypothetical protein LOC283120 |
| 25. | R60014 gi\|830709 | AK123640 gi\|34529239 | high mobility group AT-hook 2 |
| 26. | N52151 gi\|1193412 | AL833547 gi\|21734192 | synaptopodin 2 |

TABLE 3-continued

Top 250 Ranked Genes for Prediction of Neuroblastoma Clinical Outcome

| | | | |
|---|---|---|---|
| 27. | N55540 gi\|1198419 | | hypothetical protein LOC163782 |
| 28. | H65066 gi\|1023806 | NM_003385 gi\|63252921 | visinin-like 1 |
| 29. | AA973808 gi\|3148988 | NM_006040 gi\|48427666 | heparan sulfate(glucosamine) 3-O-sulfotransferase 4 |
| 30. | R93124 gi\|967290 | NM_001353 gi\|56121816 | aldo-keto reductase family 1, member C1 (dihydrodiol dehydorgenase 1; 20-alpha(3-alpha)-hydroxysteriod dehydrogenase) |
| 31. | W72068 gi\|1382338 | BX648323 gi\|34367482 | *Homo sapiens* cDNA: FLJ21545 fis, clone COL06195 |
| 32. | R61341 gi\|832036 | NM_005295 gi\|4885308 | G protein-coupled receptor 22 |
| 33. | AA044023 gi\|1521944 | | *Homo sapiens* transcribed sequence with weak similarilty to protein ref: NP_060312.1 (*H. sapiens*) hypothetical protein FLJ20489 [*Homo sapiens*] |
| 34. | AA034366 gi\|1506175 | BU620794 gi\|23287009 | Clone ID: 449512 |
| 35. | AA777001 | NM_003914 gi\|16306528 | cyclin A1 |
| 36. | R37656 gi\|795112 | NM_181795 gi\|32483391 | protein kinase (cAMP-dependent, catalytic inhibitor beta) |
| 37. | H40665 gi\|916717 | BX093245 gi\|27823200 | *Homo sapiens* full length insert cDNA YN61C04 |
| 38. | AI623173 gi\|4648098 | | galanin |
| 39. | AI205664 gi\|3764336 | BM701300 gi\|19014558 | *Homo sapiens* transcribed sequence with strong similarity to protein ref: NP_055378.1 (*H. sapiens*) spondyloepiphyseal dysplasia, late; sedlin [*Homo sapiens*] |
| 40. | AA918535 gi\|3058425 | BQ012257 gi\|19737158 | hypothetical protein LOC221303 |
| 41. | AA394198 gi\|2047217 | BE970051 gi\|10582984 | *Homo sapiens* transcribed sequence with strong similarilty to protein sp: P07478 (*H. sapiens*) TRY2_HUMAN Trypsin II precursor (Anionic trypsinogen) |
| 42. | R77783 gi\|852893 | AL519577 gi\|45695127 | *Homo sapiens* transcribed sequence with strong similarity to protein ref: NP_003610.1 (*H. sapiens*) protease, serine, 12 (neurotrypsin, motopsin) [*Homo sapiens*] |
| 43. | AA029597 gi\|1497001 | NM_001719 gi\|4502426 | bone morphogenetic protein 7 (osteogenetic protein 1) |
| 44. | AA621201 gi\|2525140 | NM_003459 gi\|52630414 | solute carrier family 30 (zinc transporter), member 3 |
| 45. | AA173755 gi\|1754078 | | hypothetical protein FLJ10539 |
| 46. | N22620 gi\|1128754 | NM_181847 gi\|40556374 | amphoterin induced gene 2 |
| 47. | AI924357 gi\|5660321 | NM_001354 gi\|45446741 | aldo-keto reductase family 1, member C2 (dihydrodiol dehydrogenase 2; bile acid binding protein; 3-alpha hydroxysteroid dehydrogenase, type III) |
| 48. | AA155913 gi\|1727531 | NM_000900 gi\|49574513 | matrix Gla protein |
| 49. | R42630 gi\|817391 | | proprotein convertase subtilisin/kexin type 1 |
| 50. | AI005515 gi\|3215025 | NM_000189 gi\|40806188 | hexokinase 2 |
| 51. | R34343 gi\|791244 | BX107971 gi\|27834959 | *Homo sapiens* transcribed sequences Clone ID: 136502 |
| 52. | AI830281 gi\|5450952 | BX365439 gi\|46286082 | *Homo sapiens* melanoma antigen family A9 (MAGEA9) mRNA, partial cds |
| 53. | AI539460 gi\|4453595 | NM_000880 gi\|8610152 | interleukin 7 |
| 54. | AA928660 gi\|3076951 | NM_003619 gi\|21327713 | protease, serine, 12 (neurotrypsin, motospin) |
| 55. | T60160 gi\|661997 | NM_031412 gi\|56676368 | GABA(A) receptor-associated protein like 1 |
| 56. | AA401404 gi\|2053629 | NM_080831 gi\|30061487 | defensin, beta 129 |

TABLE 3-continued

Top 250 Ranked Genes for Prediction of Neuroblastoma Clinical Outcome

| | | | |
|---|---|---|---|
| 57. | AA705735 gi|2715653 | NM_014903 gi|66933019 | neuron navigator 3 |
| 58. | AA235116 gi|1859553 | NM_002867 gi|19923749 | RAB3B, member RAS oncogene family |
| 59. | AA936779 gi|3094813 | NM_005555 gi|17505187 | keratin 6B |
| 60. | W60582 gi|1367411 | NM_018476 gi|685332 | brain express, X-linked 1 |
| 61. | R66103 gi|838741 | | Homo sapiens transcribed sequences Clone ID: 140210 |
| 62. | AA975538 gi|3151330 | | Homo sapiens transcribed sequences Clone ID: 1558233 |
| 63. | AA476300 gi|2204511 | NM_020680 gi|19923565 | SCY1-like (S. cerevisiae) |
| 64. | H23444 gi|892139 | AK092129 gi|21750647 | Homo sapiens TAFA1 mRNA, complete cds |
| 65. | R15791 gi|768206 | NM_001035 gi|4506756 | ryanodine receptor 2 (cardiac) |
| 66. | AA041400 gi|1517689 | NM_006726 gi|16904380 | LPS-responsive vesicle trafficking, beach and anchor containing |
| 67. | AI000557 gi|3191111 | NM_004386 gi|4758083 | chondroitin sulfate proteoglycan 3 (neurocan) |
| 68. | AI268450 gi|3887617 | | Homo sapiens transcribed sequnces Clone ID: 1880885 |
| 69. | R92994 gi|965348 | NM_002426 gi|4505206 | matrix metalloproteinase 12 (macrophage elastase) |
| 70. | W81677 gi|1392187 | NM_000079 gi|4557456 | cholinergic receptor, nicotinic, alpha polypeptide 1 (muscle) |
| 71. | AA903531 gi|3038654 | AI961087 gi|5753868 | Homo sapiens transcribed sequence with weak similarily to protein pir: T47135 (H. sapiens) T47135 hypothetical protein DKFZp761L0812.1 human (fragment) |
| 72. | H23463 gi|892158 | | Homo sapiens transcribed sequences Clone ID: 52329 |
| 73. | R91170 gi|958710 | NM_005520 gi|5031752 | heterogeneous nuclear ribonucleoprotein H1 (H) |
| 74. | AI240426 gi|3835823 | NM_199188 gi|40353739 | c-Mpl binding protein |
| 75. | R68243 gi|841760 | AK055280 gi|16549979 | Homo sapiens cDNA FLJ30718 fis, clone FCBBF2001675 |
| 76. | N50114 gi|1191280 | NM_018440 gi|63054863 | phosphoprotein associated with glycosphingolipid-enriched microdomains |
| 77. | R15853 gi|768268 | BX648828 gi|34367993 | prokineticin 2 |
| 78. | AA772904 gi|2825746 | NM_004807 gi|4758565 | heparan sulfate 6-O-sulfotransferase 1 |
| 79. | AI290481 gi|3933255 | | Homo sapiens transcribed sequences Clone ID: 1880352 |
| 80. | N63057 gi|1210886 | NM_020403 gi|45243537 | protocadherin 9 |
| 81. | AA866153 gi|2958429 | | Homo sapiens transcribed sequences Clone ID: 1469434 |
| 82. | AA976650 gi|3154096 | BM716109 gi|19029367 | Homo sapiens transcribed sequence with weak similarily to protein ref: NP_009056.1 (H. sapiens) ubiquitously transcribed tetratricopeptide repeat gene, Y chromosome; Ubiquitously transcribed TPR gene on Y chromosome [Homo sapiens] |
| 83. | N58494 gi|1202384 | | glycine dehydrogenase (decarboxylating; glycine decarboxylase, glycine cleavage system protein P) |
| 84. | H90431 gi|1080861 | NM_000024 gi|15718673 | adrenergic, beta-2-, recpetor surface |
| 85. | AI391632 gi|4217636 | NM_002163 gi|55953136 | interferon consensus sequence binding protein 1 |
| 86. | AI028034 gi|3245343 | NM_001778 gi|21361570 | CD48 antigen (B-cell membrane protein) |
| 87. | H40323 gi|916375 | BC043430 gi|34193298 | Homo sapiens cDNA clone IMAGE: 5294683, partial cds |
| 88. | AA962159 gi|3134323 | NM_004714 gi|4758221 | dual-specificity tyrosine-(Y)-phosphorylation regualted kinase 1B |

TABLE 3-continued

Top 250 Ranked Genes for Prediction of Neuroblastoma Clinical Outcome

| | | | |
|---|---|---|---|
| 89. | AA913480 gi|3052872 | | killer cell lectin-like receptor subfamily C, member 1 |
| 90. | AA188378 gi|1775412 | | *Homo sapiens*, clone IMAGE: 4865966, mRNA |
| 91. | N47979 gi|1189145 | BX538341 gi|31874840 | *Homo sapiens* mRNA; cDNA DKFZp686C13222 (from clone DKFZp686C13222) |
| 92. | T95274 gi|733898 | AF146695 gi|4887201 | *Homo sapiens* clone IMAGE: 120162 mRNA sequence |
| 93. | AA424574 gi|2103544 | NM_015529 gi|24308084 | monooxygenase, DBH-like 1 |
| 94. | N93122 gi|1265431 | | *Homo sapiens* transcribed sequence with weak similarity to protein sp: P39191 (*H. sapiens*) ALU4_HUMAN Alu subfamily SB2 sequence contamination warning entry |
| 95. | AA707167 gi|2717085 | AU253973 gi|34322686 | *Homo sapiens* transcribed sequences Clone ID: 451394 |
| 96. | AA025819 gi|1491222 | NM_002048 gi|4503918 | growth arrest-specific 1 |
| 97. | AI493478 gi|4394481 | NM_001852 gi|31083125 | collagen, type IX, alpha 2 |
| 98. | N52812 gi|1193978 | BX105296 gi|27833450 | *Homo sapiens* transcribed sequences Clone ID: 244312 |
| 99. | H08643 gi|873465 | NM_001940 gi|55750040 | dentatorubral-pallidoluysian atrophy (atrophin-1) |
| 100. | AI248323 gi|3843720 | AI248323 gi|3843720 | *Homo sapiens* transcribed sequences Clone ID: 1850044 |
| 101. | AA779892 gi|2839223 | NM_019845 gi|54792141 | candidate mediator of the p53-dependent G2 arrest |
| 102. | R00809 gi|750545 | NM_006030 gi|54112393 | calcium channel, voltage-dependent, alpha 2/delta subunit 2 |
| 103. | AA461473 gi|2185337 | NM_006393 gi|5453757 | nebulette |
| 104. | H05706 gi|869258 | H05706 gi|869258 | *Homo sapiens* transcribed sequences Clone ID: 43705 |
| 105. | W16836 gi|1291224 | NM_002122 gi|52426772 | major histocompatibility complex, class II, DQ alpha 1 |
| 106. | N50742 gi|1191908 | AL832194 gi|21732739 | endothelial differentiation, sphingolipid G-protein-coupled receptor, 3 |
| 107. | R53455 gi|815357 | NM_019029 gi|22027515 | carboxypeptidase, vitellogenic-like |
| 108. | AA071005 gi|1578558 | NM_144702 gi|21389614 | hypothetical protein FLJ32884 |
| 109. | W73144 gi|1383279 | NM_002298 gi|7382490 | lymphocyte cytosolic protein 1 (L-plastin) |
| 110. | T70327 gi|681475 | T70327 gi|681475 | *Homo sapiens* transcribed sequence with weak similarity to protein ref: NP_001432.1 (*H. sapiens*) fatty acid amide hydrolase [*Homo sapiens*] |
| 111. | AA890136 gi|3017015 | | *Homo sapiens* similar to expressed sequence AW121567 (LOC374514), mRNA |
| 112. | AI300926 gi|3960272 | BC042456 gi|27502868 | *Homo sapiens*, clone IMAGE: 4818531, mRNA |
| 113. | R62835 gi|834714 | BX101784 gi|27831388 | *Homo sapiens* transcribed sequences Clone ID: 138974 |
| 114. | AI269361 gi|3888528 | | DKFZP564C152 protein |
| 115. | AA877815 gi|2986780 | NM_145728 gi|22027637 | desmuslin |
| 116. | AI807646 gi|5394212 | | gamma-aminobutyric acid (GABA) A receptor, alpha 5 |
| 117. | AA916325 gi|3055717 | NM_003739 gi|24497582 | aldo-keto reductase family 1, member C3 (3-alpha hydroxysteroid dehydrogenase, type II) |
| 118. | N20820 gi|1126001 | NM_176814 gi|39753952 | hypothetical protein LOC168850 |
| 119. | AA972401 gi|3147691 | BX100412 gi|27844465 | *Homo sapiens* transcribed sequences Clone ID: 1584099 |
| 120. | H51419 gi|991260 | NM_172107 gi|26051263 | potassium voltage-gated channel, KQT-like subfamily, member 2 |
| 121. | AA133350 gi|1690318 | NM_003551 gi|37622352 | non-metastatic cells 5, protein expressed in (nucleoside-diphosphate kinase) |

TABLE 3-continued

Top 250 Ranked Genes for Prediction of Neuroblastoma Clinical Outcome

| | | | |
|---|---|---|---|
| 122. | R41560 gi|816860 | AF131795 gi|4406623 | Homo sapiens clone 25052 mRNA sequence |
| 123. | R98407 gi|985119 | NM_002585 gi|4505622 | pre-B-cell leukemia transcription factor 1 |
| 124. | R13972 gi|767048 | NM_014141 gi|21071040 | contactin associated protein-like 2 |
| 125. | AA907347 gi|3042807 | | Homo sapiens cDNA FLJ40156 fis, clone TESTI2014385 |
| 126. | AA427924 gi|2111686 | NM_006108 gi|124307904 | spondin 1, (f-spondin) extracellular matrix protein |
| 127. | R56219 gi|826325 | NM_001796 gi|16306538 | cadherin 8, type 2 |
| 128. | AA479102 gi|2207658 | NM_002738 gi|47157320 | protein kinase C, beta 1 |
| 129. | AA775372 gi|2834706 | NM_013272 gi|7706713 | solute carrier family 21 (organic anion transporter), member 11 |
| 130. | AA778985 gi|2838316 | NM_002375 gi|47519638 | microtubule-associated protein 4 |
| 131. | AA664081 gi|2618072 | | Homo sapiens transcribed sequences Clone ID: 855448 |
| 132. | AA453997 gi|2167666 | NM_002976 gi|4506810 | sodium channel, voltage-gated, type VII, alpha |
| 133. | H20717 gi|889412 | AK125162 gi|34531161 | Homo sapiens cDNA FLJ43172 fis, clone FCBBF3007242 |
| 134. | AA971518 gi|3146808 | | Homo sapiens transcribed sequences Clone ID: 1584398 |
| 135. | AA436138 gi|2141052 | BG576442 gi|13584095 | Homo sapiens transcribed sequences Clone ID: 754346 |
| 136. | AI088327 gi|3427386 | | Homo sapiens transcribed sequences Clone ID: 1690886 |
| 137. | AI826477 gi|5447148 | NM_001803 gi|68342029 | CD52 (CAMPATH-1 antigen) |
| 138. | AA455911 gi|2178687 | | ATP-binding cassette, sub-family B (MDR/TAP), member 1 |
| 139. | AI277247 gi|3899515 | AI277247 gi|3899515 | Homo sapiens transcribed sequences Clone ID: 1893735 |
| 140. | AA598653 gi|2432236 | NM_006475 gi|5453833 | osteoblast specific factor 2 (fasciclin 1-like) |
| 141. | AA927036 gi|3075933 | NM_004801 gi|21070965 | neurexin 1 |
| 142. | N59441 gi|1203331 | NM_021723 gi|21536387 | a disintegrin and metalloproteinase domain 22 |
| 143. | R49458 gi|1820356 | | Homo sapiens cDNA: FLJ23131 fis, clone LNG08502 |
| 144. | N50880 gi|1192046 | BC030554 gi|20988582 | T cell receptor gamma variable 9 |
| 145. | AA486362 gi|2215168 | AK128524 gi|34535933 | Homo sapiens immunoglobulin kappa light chain mRNA, partial cds |
| 146. | H10403 gi|875225 | NM_002839 gi|4506308 | protein tyrosine phosphatase, receptor type, D |
| 147. | AA719150 gi|2732249 | BC035185 gi|34191447 | Homo sapiens hypothetical protein LOC285194, mRNA (cDNA clone IMGE: 5266409), partial cds |
| 148. | AA935694 gi|3092851 | NM_006043 gi|5174462 | heparan sulfate (glucosamine) 3-O-sulfotransferase 2 |
| 149. | AI762428 gi|5178095 | NM_004114 gi|16306544 | fibroblast growth factor 13 |
| 150. | AA426264 gi|2107605 | NM_002417 gi|19923216 | antigen identified by monoclonal antibody Ki-67 |
| 151. | H77627 gi|1055716 | NM_138424 gi|19923948 | kinesin family member 12 |
| 152. | AA699493 gi|2703649 | | Homo sapiens transcribed sequences Clone ID: 432477 |
| 153. | N91921 gi|1264230 | AA994097 gi|3180642 | Homo sapiens TCR BV3 mRNA for T cell receptor beta chain (CDR3 region), partial cds, isolate: HTLV-1 myopathy case3, clone: Tax tetramer-5 |
| 154. | AA427491 gi|2111387 | BC041074 gi|27370838 | Human T-cell receptor active alpha-chain mRNA from Jurkat cell line |
| 155. | T67053 gi|676493 | | Homo sapiens cDNA FLJ26905 fis, clone RCT01427, highly similar to Ig lambda chain C regions |
| 156. | N24966 gi|1139116 | | Homo sapiens transcribed sequences Clone ID: 267420 |
| 157. | AA431741 gi|2115449 | NM_024629 gi|38016934 | KSHV latent nuclear antigen interacting protein 1 |

TABLE 3-continued

Top 250 Ranked Genes for Prediction of Neuroblastoma Clinical Outcome

| | | | |
|---|---|---|---|
| 158. | AA908678 gi|3048083 | | *Homo sapiens* transcribed sequences Clone ID: 1522487 |
| 159. | AA992658 gi|3178392 | AL832666 gi|21733242 | hypothetical protein LOC157570 |
| 160. | AA481076 gi|2210628 | NM_002358 gi|6466452 | MAD2 mitotic arrest deficient-like 1 (yeast) |
| 161. | AA931491 gi|3085877 | BX648964 gi|34368136 | *Homo sapiens* mRNA; cDNA DKFZp686J0156 (from clone DKFZp686J0156) |
| 162. | AA398118 gi|2051227 | | *Homo sapiens* transcribed sequence with weak similarity to protein ref: NP_060265.1 (*H. sapiens*) hypothetical protein FLJ20378 [*Homo sapiens*] |
| 163. | AA668470 gi|2629969 | NM_003617 gi|41387215 | regulator of G-proetin signalling 5 |
| 164. | AA156674 gi|1728353 | NM_001684 gi|48255956 | ATPase, Ca++ transporting, plasma membrane 4 |
| 165. | AA458779 gi|2183686 | NM_000191 gi|62198231 | 3-hydroxymethyl-3-methylglutaryl-Coenzyme A lyase (hydroxymethylglutaricaciduria) |
| 166. | AI159901 gi|3693281 | XM_371717 gi|51464322 | odd Oz/Ten-m homolog 3 |
| 167. | AA976699 gi|3154145 | NM_001275 gi|10800418 | chromagranin A (parathyroid secretory protein 1) |
| 168. | AA629901 gi|2552512 | NM_152765 gi|34303955 | hypothetical protein MGC33510 |
| 169. | AW510753 gi|7148831 | NM_001474 gi|4503882 | G antigen 5 |
| 170. | AI245607 gi|3841004 | NM_007101 gi|21361377 | sarcosine dehydrogenase |
| 171. | AA479967 gi|2208118 | | *Homo sapiens* cDNA FLJ44429 fis, clone UTERU2015653 |
| 172. | AA677643 gi|2658165 | NM_018640 gi|41350202 | neuronal specific transcription factor DAT1 |
| 173. | W24873 gi|1302728 | NM_000147 gi|24475878 | fucosidase, alpha-L-1, tissue |
| 174. | W63783 gi|1371384 | NM_023002 gi|30794471 | transmembrane 6 superfamily member 2 |
| 175. | AA676876 gi|2657398 | NM_016601 gi|16445406 | potassium channel subfamily K, member 9 |
| 176. | AA772803 gi|2825645 | NM_001117 gi|10947062 | adenylate cyclase activating polypeptide 1 (pituitary) |
| 177. | R56614 gi|826720 | XM_379927 gi|51466511 | plexin A4 |
| 178. | H13691 gi|878511 | NM_002118 gi|18641376 | major histocompatibility complex, class II, DM beta |
| 179. | AA700815 gi|2703980 | | *Homo sapiens* transcribed sequences Clone ID: 436059 |
| 180. | AA400292 gi|2054172 | AK092836 gi|21751529 | *Homo sapiens* cDNA FLJ35517 fis, clone SPLEN2000698. |
| 181. | R61128 gi|831823 | NM_133445 gi|20143963 | glutamate receptor, ionotropic, N-methyl-D-aspartate 3A |
| 182. | AA490967 gi|2220140 | NM_145323 gi|21735585 | oxysterol binding protein-like 3 |
| 183. | AA449490 gi|2163240 | XM_166254 gi|51468857 | odd Oz/ten-m homolog 4 |
| 184. | AI333640 gi|4070199 | AI333640 gi|4070199 | *Homo sapiens* transcribed sequences Clone ID: 1930391 |
| 185. | AA424950 gi|2107038 | NM_005225 gi|12669910 | E2F transcription factor 1 |
| 186. | AI018400 gi|3232919 | NM_173509 gi|34222229 | hypothetical protein MGC16664 |
| 187. | AA457267 gi|2179987 | NM_015980 gi|34222326 | HMP19 protein |
| 188. | AI433655 gi|4290700 | NM_000878 gi|23238195 | interleukin 2 receptor, beta |
| 189. | AA476576 gi|2204787 | NM_018492 gi|18490990 | T-LAK cell-originated protein kinase |
| 190. | AA664101 gi|2618092 | NM_000689 gi|25777722 | aldehyde dehydrogenase 1 family, member A1 |
| 191. | AA431753 gi|2115461 | NM_016315 gi|56550114 | PTB domain adaptor protein CED-6 |
| 192. | AA426561 gi|2106816 | NM_016300 gi|68161512 | *Homo sapiens* cDNA FLJ36329 fis, clone THYMU2005855 |
| 193. | AA496047 gi|2229368 | NM_145893 gi|22538408 | ataxin 2-binding protein 1 |

TABLE 3-continued

Top 250 Ranked Genes for Prediction of Neuroblastoma Clinical Outcome

| | | | |
|---|---|---|---|
| 194. | AA865464 gi|2957740 | NM_002346 gi|4505048 | lymphocyte antigen 6 complex, locus E |
| 195. | R52543 gi|814445 | NM_199051 gi|39979637 | *Homo sapiens* similar to RIKEN cDNA B830045N13 (LOC339479), mRNA |
| 196. | N32904 gi|1153303 | NM_020455 gi|37620168 | *Homo sapiens* cDNA FLJ16029 fis, clone KIDNE2012945, weakly similar to PROCOLLAGEN C-PROTEINASE ENHANCER PROTEIN PRECURSOR |
| 197. | H98855 gi|1123523 | NM_005761 gi|5032222 | plexin C1 |
| 198. | AA460282 gi|2185098 | NM_005864 gi|14589877 | embryonal Fyn-associated substrate |
| 199. | AA775521 gi|2834855 | NM_001103 gi|4501892 | actinin, alpha 2 |
| 200. | AA464600 gi|2189484 | NM_002467 gi|31543215 | v-myc myelocytomatosis viral oncogene homolog (avian) |
| 201. | AI356230 gi|4107851 | XM_171054 gi|51463939 | KIAA0527 protein |
| 202. | AA703077 gi|2706190 | NM_030651 gi|21361926 | chromosome 6 open reading frame 31 |
| 203. | AA865362 gi|2957638 | NM_016941 gi|45243550 | delta-like 3 (*Drosophila*) |
| 204. | AI129115 gi|3597629 | AK001013 gi|7022026 | *Homo sapiens* cDNA FLJ10151 fis, clone HEMBA1003402. |
| 205. | AA948041 gi|3109294 | NM_030906 gi|44890053 | serine/threonine kinase 33 |
| 206. | AA451750 gi|2165419 | NM_006080 gi|5174672 | sema domain, immunoglobulin domain (Ig), short basic domain, secreted, (semaphorin) 3A |
| 207. | AA887204 gi|3002312 | | *Homo sapiens* transcribed sequences Clone ID: 1502008 |
| 208. | AA476257 gi|2204468 | NM_014333 gi|22095346 | immunoglobulin superfamily, member 4 |
| 209. | AA397813 gi|2051021 | NM_001827 gi|4502858 | CDC28 protein kinase regulatory subunit 2 |
| 210. | AA663726 gi|2617717 | | *Homo sapiens* transcribed sequences Clone ID: 969593 |
| 211. | AI143189 gi|3664998 | | *Homo sapiens* transcribed sequence with weak similarity to protein ref: NP_055405.1 (*H. sapiens*) endogenous retroviral family W, env(C7), member 1 (syncytin); envelope protein [*Homo sapiens*] |
| 212. | N41052 gi|1164650 | | sine oculis homeobox homolog 3 (*Drosophila*) |
| 213. | R48248 gi|810274 | NM_024838 gi|34222383 | hypothetical protein FLJ22002 |
| 214. | N66644 gi|1218769 | NM_016142 gi|7705854 | hydroxysteroid (17-beta) dehydrogenase 12 |
| 215. | AW157797 gi|6229198 | NM_000517 gi|14043068 | hemoglobin, alpha 2 |
| 216. | AI278518 gi|3900786 | NM_033664 gi|16306533 | cadherin 11, type 2, OB-cadherin (osteoblast) |
| 217. | AA678971 gi|2659493 | NM_003835 gi|4506520 | regulator of G-protein signalling 9 |
| 218. | AA972020 gi|3147310 | | *Homo sapiens* transcribed sequences Clone ID: 1583668 |
| 219. | AI306467 gi|3989538 | NM_004540 gi|33519480 | neural cell adhesion molecule 2 |
| 220. | AA460685 gi|2185805 | NM_001168 gi|59859877 | baculoviral IAP repeat-containing 5 (survivin) |
| 221. | AA705316 gi|2715234 | | *Homo sapiens* mRNA similar to joined to JAZF1 (cDNA clone MGC: 52103 IMAGE: 5736798), complete cds |
| 222. | N20796 gi|1125977 | NM_018841 gi|51036602 | guanine nucleotide binding protein (G protein), gamma 12 |
| 223. | AI055991 gi|3329857 | NM_152545 gi|22749128 | GPI-gamma 4 |
| 224. | N75004 gi|1237582 | AK124396 gi|34530173 | *Homo sapiens* cDNA FLJ42405 fis, clone ASTRO3000474 |
| 225. | N51740 gi|1192906 | NM_014936 GI: 54124344 | ectonucleotide pyrophosphatase/phosphodiesterase 4 (putative function) |
| 226. | N51614 gi|1192780 | NM_005892 gi|33356147 | formin-like |

TABLE 3-continued

Top 250 Ranked Genes for Prediction of Neuroblastoma Clinical Outcome

| | | | |
|---|---|---|---|
| 227. | AA400234 gi\|2054248 | AF001893 gi\|2529723 | cDNA DKFZp686L01105 (from clone DKFZp686L01105) |
| 228. | AA400495 gi\|2054366 | | piwi-like 2 (*Drosophila*) |
| 229. | H92875 gi\|1099203 | NM_014944 gi\|57242754 | calsyntenin 1 |
| 230. | AA908902 gi\|3048307 | NM_013282 gi\|16507203 | ubiquitin-like, containing PHD and RING finger domains, 1 |
| 231. | AI685539 gi\|4896833 | AB007954 gi\|3413928 | *Homo sapiens* mRNA, chromosome 1 specific transcript KIAA0485 |
| 232. | T52564 gi\|654424 | NM_014585 gi\|31543639 | solute carrier family 40 (iron-regulated transporter), member 1 |
| 233. | AA677149 gi\|2657671 | NM_016184 gi\|37577113 | C-type (calcium dependent, carbohydrate-recognition domain) lectin, superfamily member 6 |
| 234. | AA910828 gi\|3050118 | | *Homo sapiens* transcribed sequences Clone ID: 1520938 |
| 235. | AA620455 gi\|2524394 | NM_033495 gi\|45643137 | BTB and kelch domain containing 2 |
| 236. | T96951 gi\|735575 | | *Homo sapiens* zinc finger protein (ZFD25), mRNA (cDNA cone IMAGE: 6146402), partial cds |
| 237. | T70329 gi\|681477 | | *Homo sapiens* transcribed sequence with weak similarity to protein ref: NP_055474.1 (*H. sapiens*) KIAA0377 gene product [*Homo sapiens*] |
| 238. | AI268241 gi\|3887408 | | *Homo sapiens* transcribed sequences Clone ID: 1880732 |
| 239. | AI174481 gi\|3721334 | NM_052918 gi\|61743972 | VPS10 domain recpetor protein SORCS 1 |
| 240. | AA490279 gi\|2219452 | NM_201266 gi\|41872561 | neuropilin 2 |
| 241. | AA464729 gi\|2189613 | NM_014501 gi\|7657045 | ubiquitin carrier protein |
| 242. | AA158584 gi\|1733395 | NM_173060 gi\|27765084 | calpastatin |
| 243. | AI051108 gi\|3307913 | AB037805 gi\|7243148 | KIAA1384 protein |
| 244. | AI630806 gi\|4682136 | AB014544 gi\|3327101 | KIAA0644 gene product |
| 245. | AA664195 gi\|2618186 | NM_002124 gi\|4504410 | major histocompatibility complex, class II, DR beta 3 |
| 246. | H28091 gi\|898444 | NM_000304 gi\|24430161 | peripheral myelin protein 22 |
| 247. | AA464180 gi\|2189064 | NM_032621 gi\|50658085 | X-linked protein |
| 248. | AI693344 gi\|4970684 | | SRY (sex determining region Y)-box 5 |
| 249. | AA933862 gi\|3090130 | | CD3E antigen, epsilon polypeptide (TiT3 complex) |
| 250. | H90890 gi\|1081320 | | *Homo sapiens* transcribed sequence with weak similarity to protein ref: NP_060954.1 (*H. sapiens*) hOAT4 [*Homo sapiens*] |

Table 3 shows the top 250 ranked genes for predicting the outcome of a patient having neuroblastoma. Table 3 provides exemplary sequences for each of genes or polynucleotides by Unigene No., Accession No. and a corresponding SEQ ID NO:, other polynucleotide sequences and/or amino acid sequences can be readily identified by one of skill in the art. The sequence listing forms a part of this disclosure and is hereby incorporated by reference. Table 3 also shows expression level of the gene or polynucleotide in a poor outcome patient with P+ meaning the gene is upregulated in poor outcome patients and P− is downregulated in poor outcome patients. An example of expression levels of each gene or polynucleotide is shown in Tables 9A, B, and C.

One embodiment of the invention offers a selection or set of genes that are expressed in a neuroblastoma cell. Such a selection or set of genes function to predict the outcome of a patient with neuroblastoma when the gene selection from the neuroblastoma cell is compared to the expression of an identical selection of genes from a non-neuroblastoma cell, or a neuroblastoma cell associated with a good outcome and/or poor outcome. As used herein, the phrase "function to predict the outcome of a patient" can mean to identify, to be indicative of, to be highly and/or differentially expressed in patients having different outcomes. As used herein, the phrase "different outcomes" can refer to time remaining before death, survival versus death, response to a particular course of treatment, for example. In one embodiment, at least one of the genes is chosen from table 2. In another embodiment, at least one of the genes is chosen from table 2, or 3. In a further embodiment, there are at least 9 genes chosen from table 2, preferentially selected from the top ranked genes. In an even further embodiment, there are at least 9 genes chosen from table 2 or 3, preferentially selected from the top ranked genes.

The invention also includes a gene set or selection comprising at least two genes or polynucleotides selected from the group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof, or the complements thereof. In some embodiments, the gene set or selection further comprises MYCN and/or CD44. Image ID NOs corresponding to these genes or polynucleotides have been described in FIG. 7A and representative sequences corresponding to SEQ ID NOs have been provided in Tables 2 and 3 and the sequence listing that forms a part of this disclosure.

In some embodiments, the gene selection comprises at least two of the genes or polynucleotides, preferably at least three, at least four, at least five, at least six, at least seven, at least eight, at least nine, at least ten, at least eleven, at least twelve, at least thirteen, at least fourteen, at least fifteen, at least sixteen, at least seventeen, at least eighteen or at least 19 of the genes of Table 2 or the complements of these polynucleotides or genes.

In other embodiments, the gene set or selection comprises at least two genes upregulated in a neuroblastoma in patients with poor outcome. A gene set or selection comprises DLK1, PRSS3, SLIT3, or mixtures thereof. A gene set or selection may further comprise ARC, MYCN, JPH1, Hs. 434957, Hs. 346745, Hs. 120591, or mixtures thereof or complements thereof. The gene set or selection may further comprise one or more additional genes shown in Table 3 that are upregulated in a neuroblastoma cell with poor outcome (identified as P+) or the complements thereof.

In a further embodiment, the gene set or selection comprises at least two genes downregulated in a neuroblastoma cell in a patient with poor outcome. A gene set or selection comprises CD44, ARH1, CNR1, ROBO2, BTBD3, KLRC3, Hs. 196008, Hs. 124776, Hs. 119947, Hs. 349094, or mixtures thereof or complements thereof. The gene set or selection may further comprise at least one additional gene or polynucleotide downregulated in a neuroblastoma cell from a patient with poor outcome (identified as P−) as shown in Table 3 or complements thereof.

In some embodiments, the gene selection may further comprise at least one other gene or polynucleotide identified in Table 3. The gene selection may successively include each of the next 10 top ranked genes or polynucleotides as provided in Table 3 up to and including all 250 genes or polynucleotides identified in Table 3 or their complements. For example, the gene selection may further comprise at least the top twenty to thirty ranked genes, the top thirty to forty top ranked genes etc., and combinations thereof or their complements.

The gene selection or set of genes and probes or primers that can detect these genes or polynucleotides can be used to prepare a microarray, hybridization assay, PCR assay that can be used to analyze a neuroblastoma tumor cell or sample in order to provide a prediction regarding the outcome of the patient having a neuroblastoma tumor. In some embodiments, gene products, such as polypeptides, can be detected using standard methodologies such as ELISA, immunoPCR and the like. An amino acid sequence of the polypeptides encoded by the polynucleotide are available by accessing the Image ID NOs. or Accession Nos. using a publicly available database such as the source database at Stanford.

Another embodiment of the invention includes a selection of at least one product of a selection of genes. As used herein, the term "product of a gene" or "gene product" can include entities that are naturally produced by the cancer cell. Examples of gene products include, but are not limited to, DNA, mRNA, and proteins. Gene products can be utilized in methods of the invention for predicting the outcome of a patient with neuroblastoma or as a target for therapeutic treatment of a patient with neuroblastoma.

Another aspect of the invention provides a kit for predicting the outcome of a patient having a neuroblastoma. A kit for predicting the outcome of a patient having neuroblastoma comprises an agent for detecting expression of at least two genes or polynucleotides, or the complements thereof, selected from the group consisting of DLK1, PRSS3, SLIT3, and mixtures thereof, or the complements thereof, and optionally, instructions for detecting increased expression as compared to a control, wherein enhanced expression is indicative of poor outcome. The control can be prepared from one or more nonneuroblastoma cells including at least one housekeeping gene, or it can be a neuroblastoma cell from a patient or patients with good and/or poor outcomes. Examples of such information concerning expression levels of genes or polynucleotides in neuroblastoma cells form patients with good outcome and/or poor outcome is provided herein in FIG. 7B and Tables 9A, B, and C.

A number of different known assays can be utilized to determine expression levels of a gene from a cell or patient sample. These assays include, for example, microarray assays, hybridization assays, PCR assays, ELISA assays, immunoPCR assays. One embodiment, may involve detecting increased levels of one or more polypeptides in a biological sample, such as serum, from patients having neuroblastoma. In some embodiments, the agent is at least one probe or primer that can detect at least one of DLK1, PRSS3 and SLIT3. In other embodiments, the agent is at least one antibody that can detect at least one of DLK1, PRSS3, or SLIT3. Preferably, the antibody is detectably labeled with a radioactive or fluorescent moiety.

In other embodiments, a kit comprises an agent that can detect expression of at least two genes or polynucleotides selected from the group consisting of DLK1, PRSS3, ARC, SLIT3, JPH1, ARH1, CNR1, ROBO2, BTBD3, KLRC3, Hs. 434957, Hs. 346735, Hs. 120591, Hs. 196008, Hs. 124776, Hs. 119947, Hs. 349094, and mixtures thereof, or the complements thereof, and optionally, instructions providing the expression profile of at least one polynucleotide that is indicative of a poor and/or good outcome of the patient. Preferably, the expression profile of all of the genes is provided. An agent can comprise at least one probe or primer that can detect at least one of the genes or polynucleotides. In other embodiments, the agent is at least one antibody that can detect at least one polypeptide encoded by the gene or polynucleotide.

In some embodiments, the kit comprises a plurality of agents that can detect expression of all the genes or polynucleotides of Table 2, or the complements thereof. In some embodiments, the kit comprises a plurality of agents that can detect expression of at least one additional gene or polynucleotide or all of the genes or polynucleotides of Table 3, or complements thereof. The plurality of agents may comprise a primer or probe that can detect expression of each of the polynucleotides or genes, or their complements, of Table 2. Another embodiment includes a plurality of polynucleotides comprising two or more genes or polynucleotides of Table 3, or their complements, optionally attached to a solid substrate, and preferably excluding MYCN or CD44. The agents may be attached to a solid substrate such as a polystyrene plate or glass slide.

In some embodiments, the kits provide instructions that provide that a poor outcome is characterized by upregulation of at least one gene or all genes selected from the group consisting of DLK1, PRSS3, ARC, SLIT3, JPH1, Hs. 434957, Hs. 3467345, Hs. 120591, and mixtures thereof. The instructions may also provide that a poor outcome is characterized by downregulation of at least one gene or all genes selected from the group consisting of ARH1, CNR1, ROBO2, BTBD3, KLRC3, Hs. 196008, Hs. 124776, Hs. 119947, Hs. 349094, and mixtures thereof.

C. Methods of Targeting a Gene Product to Produce a Therapeutic Agent Useful to Treat Neuroblastoma.

One embodiment of the invention includes a method of targeting a product of at least one of the genes in table 2 or 3 that includes identifying a therapeutic agent having a therapeutic effect on said gene product. Another embodiment includes a method of therapeutic treatment of neuroblastoma by using a selection of genes or their products that are expressed in a neuroblastoma cell, wherein the genes and/or their products function to predict the outcome of the neuroblastoma cell when the gene selection from the neuroblastoma cell is compared to the expression of an identical selection of genes from a non-neuroblastoma cell, or a cancer cell from a patient with a good outcome and/or poor outcome. Another embodiment includes a method of targeting a product of at least one of the genes in Tables 2 or 3 for identification of an antagonist or agonist that can be utilized to treat neuroblastoma.

Another aspect of the invention involves a method of screening for an agent that modulates a gene or polynucleotide for treatment for neuroblastoma. A screening method comprises a method for detecting an agent that can modulate the expression of at least one gene or polynucleotide for which a change in expression is correlated with poor outcome in a patient or subject having neuroblastoma. In some embodiments, the genes or polynucleotides are selected from the top ranked genes of Table 2. In other embodiments, at least one of the top ranked genes of table 2 is screened excluding MYCN and/or CD44. In other embodiments, at least one gene or polynucleotide can be selected from any of the genes of Table 3.

In some embodiments, the gene or polynucleotide is upregulated in a neuroblastoma tumor cell and is associated with poor outcome. If a gene is upregulated, a method comprises identifying an antagonist of the gene or polynucleotide. A gene or polynucleotide that is upregulated comprises or is selected from the group consisting of DLK1, PRSS3, SLIT3, and mixtures thereof. In other embodiments, a gene or polynucleotide is selected from the group consisting of DLK1, PRSS3, ARC, SLIT3, JPH1, and mixtures thereof. A method comprises identifying an antagonist of at least one gene or polynucleotide upregulated in neuroblastoma cell comprising measuring expression or activity of at least one gene or polynucleotide selected from the group consisting of DLK1, PRSS3, ARC, SLIT3, JPH1, Hs. 434957, Hs. 346735, Hs. 120591, and mixtures thereof in the presence or absence of a candidate agent; and identifying the candidate agent that inhibits expression or activity of at least one of the genes or polynucleotides. The method can further comprise at least one or more genes or polynucleotides that are upregulated in a neuroblastoma cell and associated with poor outcome, such as provided in Table 3 and identified as P+.

In some embodiments, at least one gene or polynucleotide is downregulated and correlated with poor outcome of a patient having neuroblastoma. When a gene or polynucleotide is downregulated, a method comprises identifying an agonist of a gene or polynucleotide downregulated in a neuroblastoma cell comprising measuring expression or activity of at least one gene selected from the group consisting of ARH1, CNR1, ROBO2, BTBD3, KLRC3, Hs. 196008, Hs. 124776, Hs. 119947, Hs. 349094, and mixtures thereof, in the presence and absence of a candidate agent, identifying as an agonist the candidate agonist that increases the expression or activity of the gene or polynucleotide. The method can further comprise screening for an agonist of one or more of the genes or polynucleotides that are downregulated in a neuroblastoma cell and associated with poor outcome, such as provided in Table 3 and identified as P−.

Exemplary sequences for the genes, polynucleotides, or polypeptides of Tables 2 and 3 can be found in Image ID NOs and Accession Nos. as provided in FIG. 7A and Table 3, Seq ID NOs in Tables 2 and 3 and the sequence listing that forms a part of this disclosure. Complementary sequences for the genes and polynucleotides can readily be determined by one of skill in the art.

An antagonist or agonist useful as a therapeutic agent can comprise a biological or chemical entity that is based on some aspect of a gene. Examples of therapeutic agents include, but are not limited to, vaccines, antibodies, oligonucleotide DNA antisense, RNAi, chemical molecules, proteins, inhibitors, antagonists, or combinations thereof. Having a therapeutic effect on a gene product can include, but is not limited to, inhibition of some activity or process of a cell, cessation of some activity or process of a cell, an increase in some activity or process of a cell, interference with some process or activity of a cell, modification of the expression of at least one gene, modification of the expression of at least one gene product, modification of the function of at least one gene, and modification of the function of at least one gene product.

An antagonist of any of the genes, polynucleotides or gene products is effective to inhibit expression or activity of the gene or gene product and can include antisense nucleic acid, nucleic acid or protein vaccines, siRNA, aptamers, and antagonist antibodies (including humanized antibodies). An agonist of any of the genes, polynucleotides or gene products is effective to enhance or increase expression or activity of the gene or gene products and can include agonist antibodies (including humanized antibodies). Other agonists include polynucleotides providing for expression, preferably overexpression, of the downregulated gene or polynucleotide. Antibodies can be prepared by methods known to those of skill in the art and in references such as U.S. Pat. No. 6,331,415; Kohler et al., Eur. J. Immun., 6:511 (1976); Winter et al., Ann. Rev. of Immunol., 12:433 (1994); and U.S. Pat. No. 5,225, 539.

The antagonists and/or agonists identified herein may be utilized in methods to treat neuroblastoma. For example, a therapeutic agent such as a humanized antibody or antisense nucleic acid may be administered to a patient in order to downregulate expression of genes or polynucleotides that are upregulated in patients that are predicted to have a poor outcome. Such therapeutic agents may be utilitized in combination with other therapies, including conventional chemotherapeutic agents.

WORKING EXAMPLES

The following examples provide a nonlimiting illustration of various embodiments of the invention.

Example 1

Preparation of Microarrays

Preparation of Glass cDNA Microarrays, Probe Labeling, Hybridization and Image acquisition can be performed according to the protocol given below, which is a standard NHGRI protocol (http://www.nhgri.nih.gov/DIR/LCG/15K/HTML/protocol.html).

Gene-specific DNA is produced by PCR amplification of purified template plasmid DNAs from cloned ESTs. The PCR product is purified by ethanol precipitation, thoroughly resuspended in 3×SSC, and printed onto a poly-L-lysine coated slide.

The materials, reagents, and solutions used include: 96 well alkaline lysis miniprep kit (Edge BioSystems, Gaithersburg, Md.); L B Broth (Biofluids, Rockville, Md.); Superbroth (Biofluids, Rockville, Md.); dATP, dCTP, dGTP, dTTP, 100 mM each #27-2035-02, store frozen, −20° C. (Pharmacia, Peapack, N.J.); PCR primer AEK M13F (5'-GTTGTAAAACGACGGCCAGTG-3') (SEQ ID NO. 251) and AEK M13R (5'-CACACAGGAAACAGCTATG-3') (SEQ ID NO. 252) at 1 mM concentration, store frozen, −20° C.; 10×PCR Buffer, # N808-0189, and Ampli-Taq DNA polymerase, # N808-4015 store frozen, −20° C. (Perkin Elmer, Norwalk, Conn.); Carbenicillin (Gibco-BRL, Rockville, Md.); Ethanol (200 Proof USP Ethyl Alcohol); 1M Tris-HCl (pH 8); 0.5M NaEDTA (pH 8); T Low E; Buffer; 20×SSC; Glycerol (enzyme grade); Sodium Acetate (tri-hydrate); Boric Acid; Sodium Hydroxide (1M); Glacial Acetic Acid; Succinic anhydride, #23969-0 and 1-methyl-2-pyrrolidinone, #32863-4 (Aldrich Chemical Co., St. Louis, Mo.); Diethyl Pyrocarbonate (DEPC) treated $H_2O$; Master set of clone-purified, sequence verified human ESTs (e.g. gf211 release, Research Genetics, Huntsville, Ala.); 96 pin inoculating block (#VP 4088, V&P Scientific, Inc, San Diego, Calif.); Airpore Tape Sheets, (#19571, QIAGEN Inc., Valencia, Calif.); Sterile 96-well plate seals, (e.g. # SEAL-THN-STR (Elkay Products, Inc., Shrewsbury, Mass.); 96-well U-Bottom Microtiter Plates, #3799 and 96-well V-Bottom Microtiter Plates, #3894 (Corning Inc., Corning, N.Y.); Thin wall PCR plate and Cylcleseal PCR plate sealer (e.g. #1038-50-0 and #1044-39-4, Robbins Scientific Corp. Sunnyvale, Calif.); household one-gallon sealable storage bags (e.g. Glad Lock); heat sealable storage bags and heat sealer; 0.2 mm Sterile Filtration unit; Diamond scribe for writing on slides; Pyrex baking dish (~24×34×5 cm); UV transparent plastic wrap (e.g. Glad Cling Wrap); 30 slide rack (stainless steel) #113 and 30 slide glass tank, #122 (Shandon Lipshaw, Pittsburgh, Pa.); 1 L glass tank; 1 L glass beaker; 1 L graduated; cylinder; Stir bar; Slide Box (plastic with no paper or cork liners), (e.g. #60-6306-02, PGC Scientific, Gaithersburg, Md.); PCR heat cycler (e.g. DNA Engine Tetrad, MJ Research, Waltham, Mass.); Centrifuge with a horizontal ("swinging bucket") rotor with a depth capacity of 6.2 cm for spinning microtiter plates and filtration plates (e.g. Sorvall Super T 21, Sorvall Inc., Newtown, Conn.); 37° C. Shaker incubator with holders for deep-well plates; 37° C. Waterbath; 65° C. Incubator; Vortex mixer; Immunowash microtiter plate washer, #1575 (BioRad, Hercules, Calif.); pH Meter; Platform Shaker; UV Stratalinker 2400, (Stratagene La Jolla, Calif.); Stirrer/Hotplate; Robotic slide printer; −80° C. Freezer; −20° C. Freezer; 45% (w/v) Sterile Glycerol; 450 grams enzyme grade glycerol per liter 9 Autoclave and store at room temperature); T low E Buffer; 1M Tris-HCl (pH 8.0) 10 mL; 0.5 M EDTA (pH 8.0) 0.2 mL; DEPC treated $H_2O$ 990 mL (Autoclave and store at room temperature); Carbenicillin stock solution (1 gram of carbenicillin in 10 mls of sterile water, Sterile filter with a 0.2 micron filter, Store frozen at −20° C.); LB with 100 μg/ml carbenicillin (Add 1 ml of carbenicillin stock solution to 1 liter of LB, Make fresh); 3M Sodium Acetate pH=6.0 (408.24 grams sodium acetate (trihydrate) per liter, 3M acetic acid (172.4 ml per liter), Titrate the pH of the 3M sodium acetate solution to pH 6.0 with the 3M acetic acid solution, Filter sterilize using a 0.2 micron filter, Store at room temperature); Ethanol/acetate mix (Ethanol (100%) 950 ml, Sodium acetate pH=6.0, 50 ml); 1000 ml 3×SSC; DEPC $H_2O$ 42.5 ml; 20×SSC 7.5 ml; 50 ml 70% Ethanol; Ethanol (100%) 350 ml; DEPC $H_2O$ 150 ml; 500 ml.

The first step is to grow the EST clones. An exemplary method is described below. In one embodiment, the cDNA clones were obtained from Research Genetics (Huntsville, Ala.) and were their standard microarray set, which consisted of 3789 sequence-verified known genes and 2778 sequence-verified ESTs. In other embodiments, sequence verified libraries with 42,578 cDNA clones were used and obtained from Research Genetics (Huntsville, N.C.) as described in Example 3.

The sealed master plates are incubated over night at 37° C. Most suppliers provide low density bacterial cultures. Replicating directly from these dilute stocks frequently results in non-growth in the secondary culture. If making the template from a plate that had previously been cultured to high density before freezing, this initial growth step should not be used, as it will reduce the viability of the cultures.

A set of standard 96 well round (U) bottom plates is then prepared by labeling all plates and placing 100 μl of LB broth containing 100 μg/ml carbenicillin in each well. These plates are used as working copies. To preserve the master set of plates, it is useful to make replicate copies of the master plate to serve as working copies when the master plate is first replicated. The EST clones are then checked to insure that they were in a vector conferring ampicillin resistance, as is common with human IMAGE clones.

The master plates are spun briefly (about two minutes) at 1000 rpm in a horizontal microtiter plate rotor to remove condensation and droplets from the seals before opening. Bacterial culture fluid on the sealers can easily be transferred from one well to others, cross-contaminating the stocks.

Then a container is partially filled with 100% alcohol. The 96 pin-replicating tool is dipped in the alcohol, removed and then the pins were flamed.

The inoculation block is allowed to cool briefly, then the replicating tool is dipped in the master plate and then into the daughter plate. This is repeated as necessary for each plate inoculated. It is useful to color the plate corner near the A-1 well of all master and daughter plates with a marker pen before beginning the replication process in order to reduce mistakes in the relative orientation of the plates. The suggested plates have a notch at this corner as well.

The inoculated LB plates, with the lids on, are placed into a one gallon sealable bag containing a moistened paper towel and grow overnight at 37° C. Many 37° C. incubators tend to dry out microtiter plate cultures. Placing the plates in a highly humidified bag avoids this problem.

Next, deep well plates are filled with 1 ml of Superbroth (100 μg/ml carbenicillin) per well. These plates serve as the source of culture for template preparation. Using the replicating tool, the deep well plates are then inoculated directly from the freshly grown LB plates. Next, the openings of the deep well plates are covered with Qiagen Airpore Tape Sheets and the plastic lids are placed over the sheet. The plates are then placed in a 37° C. shaker incubator at 200 RPM for twenty-four hours. 50 μl of 45% (w/v) sterile glycerol is added to each well of any working plates that are to be frozen (−80° C.) and subsequently used as culture sources.

After the EST clones are grown, the plasmid templates have to be isolated. First, the lysis buffer (Edge Biosystems Kit) is warmed to 37° C. to dissolve the SDS. Then the RNAse solution is added to the resuspension buffer (Edge Biosystems Kit), 1 ml/100 ml, and stored at 4° C. The receiving plates are prepared from the Edge Biosystems Kit by adding 350 μl of ethyl alcohol to each well of the receiving plates.

The filter plate is then placed on top and secured with tape. The bacterial cultures in the deep well plates are centrifuged at 1500×g for seven minutes in a centrifuge equipped with a horizontal rotor for 96-well plates. They were then briefly inverted and excess media is tapped out on a clean paper towel. The pellets will loosen and may be lost when pouring off excess media if this step is delayed.

The pellet is then resuspended in 100 µl of Resuspension Buffer, and Vortexed until the entire pellet was re-suspended. This step is critical. Poor resuspension of the cells results in clumps of cells that do not lyse in subsequent steps. This reduces the yield and decreases the purity of the product. 100 µl of Lysis Buffer is then added and the solution is mixed gently by rocking the plates from side to side, to avoid shearing the bacterial chromosomal DNA. 100 µl of Precipitation buffer is added to each well and briefly mixed. Then, 100 µl of Neutralization buffer is added to each well and vortexed.

The contents of the deep wells are then transferred to the waiting filter plates/receiving plate stacks using the wide bore pipette tips provided in the kits. The stacked plates are then centrifuged at 1500×g for twelve minutes in a centrifuge equipped with a horizontal rotor for 96-well plates. The stacked plates are then removed from the centrifuge. The filter plates are removed and discarded. The alcohol and filtrate are decanted from the receiver plate and the excess alcohol is touched off on clean paper towels. 500 µl of 70% ethanol is added to each well and immediately decanted and excess alcohol is touched off with a clean paper towel. Then, the plates are placed in a clean drawer without their lids, covered with a clean paper towel and allowed to dry overnight.

The next day, the DNA is resuspended in 200 µl of T Low E Buffer. The top is sealed with plate sealer and rehydrated at 4° C. for at least two days before using. They are stored at −20° C. in the interim.

After the plasmid templates have been isolated, the EST inserts are amplified. For each 96 well plate to be amplified, a PCR reaction mixture is prepared containing the following ingredients: 1000 µl of 10×PCR Buffer, 20 µL of dATP (100 mM), 20 µL of dGTP (100 mM), 20 µL of dCTP (100 mM), 20 µL of dTTP (100 mM), 5 µL of AEK M13F primer (1 mM), 5 µL of AEK M13R primer (1 mM), 100 µL of Ampli-Taq polymerase (5 U/µl), and 8800 mL of $H_2O$. The 96-well PCR plates are then labeled and 100 µl of the PCR reaction mixture from above is aliquotted to each well. The plates are then gently tapped to insure that no air bubbles are trapped at the bottom of the wells. 1 µl of purified EST plasmid template from above is then added to each well. The donor and recipient plates are then marked at the corner, near the A1 well to facilitate correct orientation during transfer of the template. It is important to make sure that the pipette tips are all submerged in the PCR reaction mix when delivering the template. Missing the liquid is easier when multi-channel pipettes are used.

The following thermal cycle series is then performed: 1 initial cycle of heating to 96° C. and holding for 30 sec, 25 cycles of denaturing at 94° C. for 30 sec, reannealing at 55° C. for 30 sec, and extending at 72° C. for 150 sec, one final cycle of holding at 72° C. for 5 minutes, then cooling to ambient temperature. After the above cycle, the plates are held at 4° C. while quality controls are performed.

The quality control is done by agarose gel electrophoresis of the ESTs. If this is the first time the template for these ESTs is being amplified, 2 µl of each PCR product is analyzed on a 2% agarose gel. If amplified products from this template had been previously tested, then one row of wells from each plate amplified is analyzed. Gel imaging allowed a rough quantitation of product while giving an excellent characterization of the product. Band size, as well as the number of bands observed in the PCR products, contributed to an understanding of the final results of the hybridization. The use of gel well formats suitable for loading from 96 well plates and programmable pipetters made this form of analysis feasible on a large scale.

The materials, reagents and solutions for the quality control check included: Electrophoresis apparatus with capacity for four 50 well combs, (e.g. #D3, Owl Scientific, Woburn, Mass.); 50× Tris-Acetate Electrophoresis BufferM; Agarose; Dye Solution (Xylene Cyanol/Bromophenol Blue) (e.g. #351-081-030, Quality Biological Inc., Gaithersburg Md.); Glycerol (enzyme grade); Ethidium Bromide solution (10 mg/ml); 100 base-pair ladder size standard; Programmable, 12-channel pipetter (e.g. #2019, Matrix Technologies, Lowell, Mass.); Disposable microtiter mixing trays (e.g. Falcon #353911, Becton Dickinson, Franklin Lake, N.J.); Electrophoresis power supply; 1×TAE Buffer; 50×TAE Buffer 40 ml; Ethidium Bromide (10 mg/ml) 0.1 ml and Water 960 ml; 1000 ml; Loading Buffer; Glycerol (enzyme grade) 4.0 ml, DEPC Water 0.9 ml, and Dye Solution* 0.1 ml for a total of 5.0 ml (*THis solution is 0.25% (w/v) Xylene Cyanol and 0.25% (w/v) Bromophenol Blue); 100 bp Size Standards; DNA ladder (1 mg/ml) 50 µL, 1 M Tris-HCl (pH 8.0) 5 µl, 0.5 M EDTA (pH 8.0) 5 µl, and Loading Buffer 440 µl for a total of 500 µl The electrophoresis is carried out with a 2% agarose gel (1×TAE) with four combs (50 tooth) that is submerged in an electrophoresis apparatus with sufficient 1×TAE buffer to just cover the surface of the gel. A reservoir of Loading Buffer is prepared, using 12 wells of a microtiter plate. Then a pipetter is programmed to sequentially carry out the following steps: fill with 2 µl, fill with 1 µL, fill with 2 µl, mix a volume of 5 µl five times, expel 5 µl. Twelve (12) disposable tips are then placed on the pipetter. 2 µl of PCR product from wells A1-A12 of the PCR plate were loaded, followed by 1 µl of air, then 2 µl of Loading Buffer from the reservoir. The tips are then placed in clean wells of a disposable mixing tray and the pipette is allowed to mix the sample and loading dye. The pipette tip is then placed in a 50 well row so that the tip containing the PCR product from well A1 is in the second well of the row, and the other tips are in every other succeeding well.

The process is repeated (changing tips each time), to load PCR plate row B starting in the 3rd well, interleaved with the A row, the C row starting at well 26, and the D row at well 27, interleaved with the C row. Then 5 µl of 100 bp Size Standards are placed in wells 1 and 50. This process is repeated, to load samples from rows E, F, G, and H in the second, 50 well row of gel wells, to load samples from two 96 well PCR plates per gel, or single row samples from 16 PCR plates. To reduce diffusion and mixing, a voltage is applied to the gel for a minute between loading each well strip. This caused the DNA to enter the gel, and reduced band spreading and sample loss.

A voltage is then applied to the gel and it is run until the bromophenol blue (faster band) has nearly migrated to the next set of wells. For a gel that is 14 cm in the running dimension, and 3 cm between each row of wells, 200 volts were applied for 15 minutes. Digital photos of the gel are taken and the images stored for future reference. The gels should show bands of fairly uniform brightness distributed in size between 600 to 2000 base-pairs. Further computer analysis of such images can be carried out with image analysis packages to provide a list of the number and size of bands. Ideally this information can be made available during analysis of the data from hybridizations involving these PCR products.

After the quality control checks are run on the plates, the next step involves purifying the PCR products. 96 well V-bottom plates were filled with 200 µl per well of ethanol/acetate mix. The ethanol acetate solution used for precipitation is less acidic (pH 6) than is typically used. In this instance, more acidic solutions produce precipitates which are harder to resuspend without improving yield.

100 µl per well of PCR product is transferred into V-bottom plates and mixed by pipetting a volume of 75 µl per well four times. The plates are then placed in a −80° C. freezer for one hour or stored overnight at −20° C. The plates are stored at −20° C. if they were to be left for more than one hour, because aggressive precipitation produces precipitates which are hard to resuspend. The plates are then thawed to reduce brittleness and melt any ice, which may have formed in the wells.

The plates are loaded into a centrifuge with a horizontal microtiter plate rotor and spun at 2600×g for 40 minutes at 4° C. Next, the supernatant from each well is aspirated using the Immunowash plate washer. Settings for the depth of aspiration by the plate washer needed to be adjusted to suit the microtiter plates used. It is advisable to leave approximately 10-20 ml in the bottom of the well to avoid disturbing the pellet.

200 µl of 70% ethanol is delivered to each well in the plate using the Immunowash plate washer, and the plates are centrifuged at 2600×g for 40 minutes. The supernatant is aspirated from each well using the Immunowash plate washer, and the plates are dried overnight in a closed drawer. They should not be dried in a speed-vac because desiccated PCR products are hard to resuspend.

After the PCR products are purified, they are then resuspended by adding 40 µl of 3×SSC per well. The plates are then sealed with a foil sealer, taking care to achieve a tight seal over each well. The plates are then placed in heat sealable bags with paper towels moistened with 3×SSC and the bag is sealed with a heat sealer. The high external humidity within the sealed bag helped to keep the volumes in the individual wells from varying. The bags are then placed in a 65° C. incubator for 2 hours. The heat in the incubator is then turned off, and the plates are allowed to cool gradually in the incubator to avoid condensation on the sealers. The plates are stored at −20° C.

The yield of the PCR suspension is then checked by fluorometric determination of DNA concentration. 1 µl of resuspended PCR product from one row of wells from each plate on a 2% agarose gel was analyzed as previously described. Adequate precipitation and resuspension produce very intense bands, with no material failing to leave the loading well, and no smear of material from the band towards the loading well.

While it would be ideal to be able to exactingly quantify each EST PCR product and spot each DNA species at equivalent concentrations, it is impractical for most labs to do so when thousands of ESTs must be prepared. Fortunately, it is possible to use a strategy where excess DNA is spotted, so that the exact quantities used do not produce much variation in the observed results. When using this strategy, it is necessary to track the average productivity of the PCR reactions. Fluorometry provides a simple way to obtain an approximate concentration of the double-stranded PCR product in the PCR reaction mix.

Next, the double stranded DNA is quantified. The materials, reagents, and solutions necessary include: reference double-stranded DNA (0.5 mg/ml) (e.g. #15612-013 Gibco/BRL, Bethesda, Md.), 96 well plates for fluorescent detection (e.g. #7105, Dynex, Chantilly, Va.), Fluorometer (e.g. #LS50B, Perkin Elmer, Norwalk, Conn.), FluoReporter Blue dsDNA Quantitation Kit (#F-2962, Molecular Probes, Eugene, Oreg.), TE, 12 channel multi-pipetters, Computer equipped with Microsoft Excel software, Ds-DNA Standards: 50 µg/ml, 100 µg/ml, 250 µg/ml, 500 µg/ml, µl TE 90, 80, 50, 0 µl ds-DNA (0.5 mg/ml) 10, 20, 50, 100, (It is good practice to check both the integrity (agarose gel) and the concentration (absorbance) of the standard before use); Fluor Buffer (HoecHist 33258 solution (contains the dye at an unspecified concentration in a 1:4 mixture of DMSO:$H_2O$) (from kit) 25 µl, TNE Buffer (TNE Buffer is 10 mM Tris-HCl (pH 7.4), 2 M NaCl, 1 mM EDTA) (from kit) 10 ml.

The double stranded DNA is quantified as follows. 96 well plates are labeled for fluorescence assay. 200 µl of Fluor Buffer is added to each well. 1 µl of PCR product from each well in a row of a PCR plate is added to a row of the fluorometry plate. Samples are added to rows A through G of the fluorometry plate. In the final row of the fluorometry plate 1 µl of each of the series of ds-DNA standards 0 µg/ml (TE only), 50, 100, 250 and 500 µg/ml ds-DNA are added. This series is repeated twice in the final row.

The fluorometer is set for excitation at 346 nm and emission at 460 nm, and adjusted as necessary to read the plate. If the fluorometer used does not support automated analysis, the data table is exported to Excel. The response for the standards is tested to see that it was linear and reproducible from the range of 0 to 500 µg/ml of ds-DNA.

Next, the concentration of ds-DNA in the PCR reactions is calculated using the following equation, after subtracting the average 0 µg/ml value from all other sample and control values:

$$[\text{ds-DNA}(\mu g/ml)] = ((\text{PCR sample value})/(\text{average 100 } \mu g/ml \text{ value})) * 100$$

Constantly tracking the yields of the PCRs makes it possible to rapidly detect many ways in which PCR can fail or perform poorly. This assay can also be applied after precipitation and resuspension of the PCR products to monitor overall recovery of product. 1 µl of amplified products from one row of wells from each amplified plate by fluorometry is analyzed.

Slides are then coated with poly-L-lysine to have a surface that is both hydrophobic and positively charged. The hydrophobic character of the surface minimizes spreading of the printed spots, and the charge appears to help position the DNA on the surface in a way that makes cross-linking more efficient.

Materials, reagents, and solutions for coating the slides includes: Gold Seal Microscope Slides (#3011, Becton Dickinson, Franklin Lake, N.J.), Ethanol (100%), Poly-L-lysine (#P8920, Sigma, St. Louis, Mo.), 50 Slide Stainless Steel Rack, #900401, and 50 Slide Glass Tank, #900401, (Wheaton Science Products, Millville, N.J.), Sodium Hydroxide, Stir Plate, Stir Bar, Platform Shaker, 30 Slide Rack, #196, plastic, and 30 slide Box, #195, plastic, (Shandon Lipshaw, Pittsburgh, Pa.), Sodium Chloride, Potassium Chloride, Sodium Phosphate Dibasic Heptahydrate, Potassium Phosphate Monobasic, Autoclave, 0.2 mm Filter: Nalgene, Centrifuge: Sorvall Super 20, Slide Box (plastic with no paper or cork liners), (e.g. #60-6306-02, PGC Scientific, Gaithersburg, Md.), 1 L Glass Beaker; 1 L Graduated Cylinder, 1M Sodium Borate (pH 8.0) (Dissolve 61.83 g of Boric acid in 900 ml of DEPC $H_2O$. Adjust the pH to 8.0 with 1N NaOH. Bring volume up to one liter. Sterilize with a 0.2 micron filter and store at room temperature), Cleaning Solution ($H_2O$ 400 ml, Ethanol 600 ml, NaOH 100 g—Dissolve NaOH in $H_2O$. Add ethanol and stir until the solution clears. If the solution does not clear, add $H_2O$ until it does), and Poly-L-lysine Solution (poly-L-lysine (0.1% w/v) 35 ml PBS 35 ml $H_2O$ 280 ml 350 ml)

First, the slides are placed into 50 slide racks and the racks are placed in glass tanks with 500 ml of cleaning solution. Gold Seal Slides are highly recommended, as they have been found to have consistently low levels of autofluorescence. It is important to wear powder free gloves when handling the slides to avoid contamination.

The tanks are placed on platform shakers for two hours at 60 rpm. After being shook, the cleaning solution is poured out, and the slides are then washed in $H_2O$ for three minutes. This wash is repeated four times. The slides are then transferred to 30 slide plastic racks and placed into small plastic boxes for coating. The slides are then submerged in 200 ml poly-L-lysine solution per box. The slide boxes are then placed on platform shaker for one hour at 60 rpm. The slides are rinsed three times with $H_2O$, and submerged in $H_2O$ for one minute, and then centrifuged for two minutes at 400×g and the slide boxes used for coating are dried.

The slides are then placed back into the slide box used for coating and allowed to stand overnight before transferring to a new slide box for storage. This allowed the coating to dry before it was handled. The slides are allowed to age for two weeks on the bench, in a new slide box, before they are printed on. The coating dried slowly, becoming more hydrophobic with time.

Slide boxes used for long term storage should be plastic and free of cork lining. The glue used to affix the cork will leach out over time and give slides stored in these types of boxes a greasy film that has a high degree of autofluorescence. All glassware and racks used for slide cleaning and coating should be cleaned with highly purified $H_2O$ only, and detergent should not be used.

Once the slides are coated, they were printed. The variety of printers and pens for transferring PCR products from titer plates to slides precludes highly detailed descriptions of the process. The following steps provide a general description of the processing.

The print pens are pre-cleaned according to the manufacturer's specification. The printer slide deck is then loaded with poly-L-lysine coated slides from above. The plates containing the purified EST PCR products are thawed and centrifuged briefly, (about two minutes) at 1000 rpm in a horizontal microtiter plate rotor to remove condensation and droplets from the seals before being opened. 5 to 10 µl of the purified EST PCR products are transferred to a plate that served as the source of solution for the printer. Printing with quill-type pens usually requires that the volume of fluid in the print source was sufficiently low, so that when the pen was lowered to the bottom of the well, it was submerged in the solution to a depth of less than a millimeter. This keeps the pen from carrying a large amount of fluid on the outside of the pen shaft and producing variable, large spots on the first few slides printed.

A repetitive test print is run on the first slide. In this operation, the pens are loaded with the DNA solution, and then the pens serially deposited this solution on the first slide in the spotting pattern specified for the print. A test is run to check the size and shape of the specified spotting pattern, as well as its placement on the slide. It also serves to verify that the pens are loading and spotting, and that a single loading produced as many spots as were required to deliver material to every slide in the printer. If one or more of the pens is not performing at the desired level, it is re-cleaned or substituted with another pen and tested again. If all pens are performing, the full print is carried out.

At the end of the print, the slides are removed from the printer, labeled with the print identifier and the slide number by writing on the edge of the slide with a diamond scribe and placed in a dust free slide box to age for one week. It was useful to etch a line, which outlined the printed area of the slide, onto the first slide. This served as a guide to locate the area after the slides are processed, and the salt spots are then washed off.

The slides are placed, printed side face up, in a casserole dish and covered with cling wrap. The slides were then exposed to a 450 mJ dose of ultraviolet irradiation in the Stratalinker. Slides should have been and are aged at ambient temperature in a closed slide box for one week prior to blocking. The slides are then transferred to a 30 slide stainless steel rack and the rack is placed into a small glass tank. 6.0 g succinic anhydride is dissolved in 325 ml 1-methyl-2-pyrrolidinone in a glass beaker by stirring with a stir bar. Nitrile gloves are worn and the work is carried out in a chemical fume hood while handling 1-methyl-2-pyrrolidinone (a teratogen).

25 ml 1M sodium borate buffer (pH 8.0) is added to the beaker. The solution is allowed to mix for a few seconds, then rapidly poured into a glass tank with slides. Succinic anhydride hydrolyzed quite rapidly once the aqueous buffer solution is added. To obtain quantitative passivation of the poly-L-lysine coating, the reactive solution is brought in contact with the slides as quickly as possible. The glass tank is placed on a platform shaker in a fume hood for 20 minutes. Small particulates resulting from precipitation of reaction products may be visible in the fluid.

While the slides are incubating on the shaker a boiling $H_2O$ bath is prepared to denature the DNA on the slides. After the slides are incubated for 20 minutes, they are transferred into the boiling $H_2O$ bath. The heating element is immediately turned off after the slides are submerged in the bath. The slides are allowed to stand in the $H_2O$ bath for 2 minutes. The slides are then transferred into a glass tank filled with 100% ethanol and incubated for 4 minutes. The slides are removed and centrifuged at 400 rpm for 3 minutes in a horizontal microtiter plate rotor to dry the slides. The slides are then transferred to a clean, dust free slide box and allowed to stand overnight before being used for collection of gene expression data.

Example 2

Exemplary Method of Culturing Cells and Tumor Samples

This protocol details exemplary methods used to extract RNA from cells, purify the RNA by a combination of phase extraction and chromatography, and prepare a labeled cDNA copy of the message fraction of the purified RNA. The protocol also describes the process of making fluorescent cDNA representations of the message pools within the isolated total RNA pools. This is accomplished by using the pure total RNA as a substrate for reverse transcription in the presence of nucleotides derivatized with either a Cy3 or a Cy5 fluorescent tag.

The materials, reagents, and solutions needed include: Trizol Reagent (#15596-018, Life Technologies, Rockville, Md.); RNeasy Maxi Kit (#75162, Qiagen, Valencia, Calif.); Chloroform; Ethanol (200 Proof USP Ethyl Alcohol); DPBS (Dulbecco's phosphate buffered saline); 3M sodium acetate (pH 5.2); DATP, dCTP, dGTP, dTTP, 100 mM each, store frozen, −20° C. (#27-2035-02, Pharmacia, Peapack, N.J.); pd(T)12-18 resuspend at 1 mg/ml, and store frozen −20° C. (#27-7858, Amersham Pharmacia Biotech); Anchored oligo primer (anchored; 5'-TTT TTT TTT TTT TTT TTT TTV N-3') (SEQ ID NO.253); resuspend at 2 mg/ml, store frozen −20° C. (e.g. #3597-006, Genosys); CyTM3-dUTP, 1 mM, and CyTM5-dUTP, 1 mM, store −20° C., light sensitive; RNasinâ Rnase inhibitor, store −20° C. (#N211A, Promega); SUPERSCRIPT™ II Rnase H' Reverse Transcriptase Kit, store −20° C., (#18064-014, Life Technologies, Rockville, Md.); C0t-1 DNA, 1 mg/ml, store frozen −20° C. (#15279-011, Life Technologies, Rockville, Md.); 0.5M EDTA (pH 8.0); 1 N NaOH; 1M TRIS-HCL; (pH7.5); TE pH 7.4; DEPC water 50× Tris Acetate Buffer; 15 ml round bottom; polypropylene centrifuge tubes; 50 ml conical polypropylene centrifuge tubes; 1.5 ml; Eppendorf tubes; 0.2 ml thin wall PCR tube; MicroCon 100 (Amicon Cat No. 42412); High speed centrifuge for 15 ml tubes; Clinical centrifuge with horizontal rotor for 50 ml conical tubes; Tissue homogenizer (e.g. Polytron PT1200 with Polytron-Aggregate-Dispergier-und-Mischtechnik 147a Ch6014 #027-30-520-0, Brinkmann Instruments Inc., Westbury, N.Y.); RPE Buffer (Add 4 volumes of ethanol per volume of RPE concentrate supplied in Quiagen Kit0; RW1 Buffer (Supplied in Qiagen Kit) 75% EtOH (Ethanol (100%) 375 ml, and DEPC H2O 125 ml for a total of 500 ml); 10× low T dNTP Mix (25 μL dGTP (100 mM), 25 μL dATP (100 mM), 25 μL dCTP (100 mM), 10 μL dTTP (100 mM), and 415 μL DEPC H$_2$O for a total of 500 μL); 5× First Strand Buffer (Provided with Superscript II); TAE Buffer (50× Tris Acetate Electrophoresis Buffer 20 ml, and DEPC H2O 980 mL for a total of 1000 ml)

If the cells that are used were harvested from tissue culture, the cell pellet is washed twice in DPBS. If the cells that are used were from tissue culture, 1 ml of Trizol was added per 2×10$^7$ cells and mixed by shaking. If tissue is being used, 100 mg of frozen tissue is added directly to 4 ml of Trizol, and dissociated by homogenization with a rotating blade tissue homogenizer.

Whatever the source, 2/10 volume of chloroform is added to the cells and shook for 15 seconds, and then allowed to stand for 3 minutes, followed by centrifugation at 12,000×g for 15 minutes at 4° C. The supernatant is taken off and added to a polypropylene tube, while recording the volume of the supernatant.

Then 0.53 volumes of ethanol is slowly added to the supernatant while vortexing, this produces a final ethanol concentration of 35%. The ethanol is added drop by drop and allowed to mix completely with the supernatant before more ethanol is added. If a high local concentration of ethanol is produced, the RNA in that vicinity will precipitate.

The supernatant from an extraction of 2×10$^7$ to 1×10$^8$ cells is added to an RNeasy maxi column, which is seated in a 50 ml centrifuge tube. The tube is then centrifuged at 2880×g in a clinical centrifuge with a horizontal rotor at room temperature for 5 minutes. The flow-through is then poured back onto the top of the column and centrifuged again. This step is necessary because a significant amount of RNA is not captured by the column matrix in the first pass of the RNA containing solution through the column.

The flow-through is discarded and 15 ml of RW1 buffer is added to the column, followed by centrifugation at 2880×g for 5 minutes. The flow-through is discarded again and then 10 ml of RPE buffer is added, followed again by centrifugation at 2880×g for 5 minutes. Once again, the flow through is discarded and another 10 ml of RPE buffer is added, and the column was centrifuged at 2880×g for 10 minutes.

Next, the column is placed in a fresh 50 ml tube and add 1 ml of DEPC treated water from the kit is added to the column, and the column is allowed to stand for 1 minute. The column is then centrifuged at 2880×g for 5 minutes, and another 1 ml of water is added to the column. The column is allowed to stand for 1 minute, followed by centrifugation at 2880×g for 10 minutes.

Then, 400 μl portions of the column eluate is aliquotted to 1.5 ml Eppendorf tubes, to which 1/10 volume of 3M sodium acetate (pH 5.2) is added, along with 1 ml of ethanol. The tubes are then allowed to stand for 15 minutes, after which they are centrifuged at 12000×g at 4 C for 15 minutes. The pellet is then washed two times in 75% EtOH and stored at −80° C.

The RNA is resuspended at approximately 1 mg/ml in DEPC H$_2$O. It is then concentrated to greater than 7 mg/ml by centrifugation on a MicroCon 100 filter unit, centrifuged at 500×g, checking as necessary to determine the rate of concentration. This step removes many residual, small to medium sized, molecules that inhibit the reverse transcription reaction in the presence of fluorescently derivatized nucleotides. The concentration of RNA in the concentrated sample is then determined by spectrophotometry, and the sample was stored at −80° C.

If an anchored oligo dT primer is used, the primer is annealed to the RNA in the following 17 μl reaction (a 0.2 ml thin wall PCR tube is used so that incubations could be carried out in a PCR cycler):

| Component | addition for Cy5 labeling | addition for Cy3 labeling |
| --- | --- | --- |
| Total RNA (>7 mg/ml) | 150-200 μg | 50-80 μg |
| Anchored primer (2 μg/μl) | 1 μl | 1 μl |
| DEPC H2O | to 17 μl | to 17 μl |

If an oligo dT(12-18) primer was used, the primer was annealed to the RNA in the following 17 μl reaction:

| Component | addition for Cy5 labeling | addition for Cy3 labeling |
| --- | --- | --- |
| Total RNA (>7 mg/ml) | 150-200 μg | 50-80 μg |
| dT (12-18) primer (1 μg/μl) | 1 μl | 1 μl |
| DEPC H2O | to 17 μl | to 17 μl |

The incorporation rate for Cy5-dUTP is less than that of Cy3-dUTP, so more RNA is labeled to achieve more equivalent signal from each species.

It is then heated to 65° C. for 10 minutes and cooled on ice for 2 minutes. Then, 23 μl (8 μl of 5× first strand buffer, 4 μl of 10× low T dNTPs mix, 4 μl of Cy5 or Cy3 dUTP (1 mM), 4 μl of 0.1 M DTT, 1 μl of Rnasin (30 u/μl), and 2 μl of Superscript II (200 u/μl)) of reaction mixture containing either Cy5-dUTP or Cy3-dUTP nucleotides is added, mixed well by pipetting and a brief centrifuge spin is used to concentrate it in the bottom of the tube. Superscript polymerase is very sensitive to denaturation at air/liquid interfaces, so be careful to suppress foaming in all handling of this reaction.

It is then incubated at 42° C. for 30 min., after which 2 μl Superscript II is added, making sure the enzyme is well mixed in the reaction volume and incubated at 42° C. for 30-60 min. Then, 5 μl of 0.5M EDTA is added, making sure the reaction is stopped with EDTA before adding NaOH (the next step), since nucleic acids precipitate in alkaline magnesium solutions.

Then, 10 μl 1N NaOH is added and it is incubated at 65° C. for 60 minutes to hydrolyze residual RNA, after which it was cooled to room temperature. The purity of the sodium hydroxide solution used in this step is important. Slight contamination or long storage in a glass vessel can produce a solution that will degrade the Cy5 dye molecule, turning the solution yellow. Some researchers achieve better results by reducing the time of hydrolysis to 30 minutes.

It is then neutralized by adding 25 µl of 1M Tris-HCl (pH 7.5). Then, the labeled cDNA is desalted by adding the neutralized reaction, 400 µl of TE pH 7.5 and 20 µg of human C0t-1 DNA to a MicroCon 100 cartridge. It is then pipetted to mix, and spun for 10 minutes at 500×g. 200 µl TE pH 7.5 is added, and the solution is then concentrated to about 20-30 µl (approximately 8-10 min at 500×g). Alternatively, a smaller pore MicroCon 30 is used to speed the concentration step. In this case, the first wash is centrifuged for approximately 4.5 minutes at 16,000×g and the second (200 µl wash) for about 2.5 minutes at 16,000×g.

It is then recovered by inverting the concentrator over a clean collection tube and spinning for 3 min at 500×g. In some cases, the cy5 labeled cDNA forms a gelatinous blue precipitate that is recovered in the concentrated volume. The presence of this material signals the presence of contaminants. The more extreme the contamination, the greater the fraction of cDNA which will be captured in this gel. Even if heat solubilized, this material tends to produce uniform, non-specific binding to the DNA targets. When concentrating by centrifugal filtration, the times required to achieve the desired final volume are variable. Overly long spins can remove nearly all the water from the solution being filtered. When fluor-tagged nucleic acids are concentrated onto the filter in this fashion, they are very hard to remove, so it is necessary to approach the desired volume by conservative approximations of the required spin times. If control of volumes proves difficult, the final concentration can be achieved by evaporating liquid in the speed-vac. Vacuum evaporation, if not to dryness, does not degrade the performance of the labeled cDNA.

Next, a 2-3 µl aliquot of the Cy5 labeled cDNA is taken for analysis, leaving 18-28 µl for hybridization. This probe is run on a 2% agarose gel (6 cm wide×8.5 cm long, 2 mm wide teeth) in Tris Acetate Electrophoresis Buffer (TAE). For maximal sensitivity when running samples on a gel for fluor analysis, a loading buffer with minimal dye was used and no ethidium bromide is added to the gel or running buffer.

The gel is then scanned on a Molecular Dynamics Storm fluorescence scanner (setting: red fluorescence, 200 micron resolution, 1000 volts on PMT). Successful labeling produces a dense smear of probe from 400 bp to >1000 bp, with little pile-up of low molecular weight transcripts. Weak labeling and significant levels of low molecular weight material indicates a poor labeling. A fraction of the observed low molecular weight material is unincorporated fluor nucleotide.

Next, the fluorescent cDNA had to be hybridized to the microarray. The volume of hybridization solution required is first determined. The rule of thumb is to use 0.033 µl for each mm 2 of slide surface area covered by the cover slip used to cover the array. An array covered by a 24 mm by 50 mm cover slip required 40 µl of hybridization solution. The volume of the hybridization solution is critical. When too little solution is used, it is difficult to seat the cover slip without introducing air bubbles over some portion of the arrayed ESTs, and the cover slip will not sit at a uniform distance from the slide. If the cover slip is bowed toward the slide in the center, there will be less labeled cDNA in that area and hybridization will be non-uniform. When too much volume is applied, the cover slip will move easily during handling, leading to misplacement relative to the arrayed ESTs, and non-hybridization in some areas of the array.

For a 40 µl hybridization, the Cy3 and Cy5 labeled cDNAs are pooled into a single 0.2 ml thin wall PCR tube and the volume is adjusted to 30 µl by either adding DEPC $H_2O$, or removing water in a SpeedVac. If a vacuum device is used to remove water, high heat or heat lamps are not used to accelerate evaporation because the fluorescent dyes could be degraded.

For a 40 µl hybridization the following components are combined:

|  | High Sample Blocking | High Array Blocking |
|---|---|---|
| Cy5 + Cy3 probe | 30 µl | 28 µl |
| Poly d(A) (8 mg/ml) | 1 µl | 2 µl |
| Yeast tRNA (4 mg/ml) | 1 µl | 2 µl |
| Human C0t-1 DNA (10 mg/ml) | 1 µl | 0 µl |
| 20x SSC | 6 µl | 6 µl |
| 50x Denhardt's blocking solution | 1 µl (optional) | 2 µl |
| Total volume | 40 ul | 40 ul |

Arrays and samples can vary somewhat, making it necessary to vary the composition of the hybridization cocktail. In cases where there is residual hybridization to control repeat DNA samples on the array, more C0t-1 DNA was used, as in the High Sample Blocking formulation. When there is diffuse background or a general haze on all of the array elements, more of the non-specific blocker components is used, as in the High Array Blocking formulation.

The components are mixed well by pipetting, heated at 98° C. for 2 minutes in a PCR cycler, cooled quickly to 25° C. and 0.6 ul of 10% SDS is added. It was then centrifuged for 5 min at 14,000×g. The fluor labeled cDNAs have a tendency to form small, very fluorescent, aggregates which result in bright, punctate background on the array slide. Hard centrifugation will pellet these aggregates, preventing introduction to the array.

The labeled cDNA is applied to a 24 mm×50 mm glass cover slip and then touched with the inverted microarray. Applying the hybridization mix to the array and cover slipping it is an operation which requires some dexterity to get the positioning of the cover slip and the exclusion of air bubbles just right. It was helpful to practice this operation with buffer and plain slides before attempting actual samples. The hybridization solution is added to the cover slip first, since some aggregates of fluor remain in the solution and will bind to the first surface they touch.

The slide is then placed in a microarray hybridization chamber, 5 µl of 3×SSC is added to the reservoir, if the chamber provided one, or at the scribed end of the slide and the chamber is sealed. The chamber is submerged in a 65° C. water bath and the slide is allowed to hybridize for 16-20 hours. There are a wide variety of commercial hybridization chambers. It was worthwhile to prepare a mock hybridization with a blank slide, load it in the chamber and incubate it to test for leaks, or drying of the hybridization fluid, either of which cause severe fluorescent noise on the array.

Next, the unbound fluorescent cDNA is washed off. The hybridization chamber is removed from the water bath, cooled and carefully dried off. The chamber is unsealed and the slide is removed. As there may be negative pressure in the chamber after cooling, it is necessary to remove water from around the seals so that it is not pulled into the chamber and onto the slide when the seals are loosened.

The slide is placed, with the cover slip still affixed, into a Coplin jar filled with 0.5×SSC/0.01% SDS wash buffer. The cover slip is allowed to fall from the slide and then removed from the jar with a forceps. The slide is allowed to wash for 2-5 minutes. The slide is transferred to a fresh Coplin jar filled with 0.06×SSC, and allowed to wash for 2-5 minutes. The sequence of washes may need to be adjusted to allow for more aggressive noise removal, depending on the source of the sample RNA. Useful variations are to add a first wash which is 0.5×SSC/0.1% SDS or to repeat the normal first wash twice.

The slide is then transferred to a slide rack and centrifuged at low rpm (700-1000) for 3 minutes in a clinical centrifuge equipped with a horizontal rotor for microtiter plates. If the slide is simply air dried, it frequently acquires a fluorescent haze. Centrifuging off the liquids results in a lower fluorescent background. As the rate of drying can be quite rapid, it is suggested that the slide be placed in the centrifuge immediately upon removal from the Coplin jar.

Image analysis can be performed using DeArray software (Chen, Y., Dougherty, E. R. and Bittner, M. L. Ratio-based decisions and the quantitative analysis of cDNA microarray images, *Biomedical Optics* 2, 364-374 (1997).

Example 3

Predicting Clinical Outcome for Patients with Neuroblastoma

Fifty-six pre-treatment primary neuroblastoma (NB) tumor samples from 49 NB patients with outcome information were obtained retrospectively from 3 sources presenting between 1992-2000 (Table 4). All patients were treated according to local or national guidelines that followed similar protocols, which included "wait-and-see" after surgery or combinations of vincristine, doxorubicin, carboplatin, cisplatin, cyclophosphamide, melphalan and etoposide, depending on the risk factors. All samples were anonymized, and our protocol was deemed exempt from the NIH Multiple Project Assurance.

TABLE 4

Neuroblastoma samples used in the study and ANN prognostic prediction

| Sample label | Year of Diagnosis | Sample Source | Age at Diagnosis (yrs) | INSS Stage | MYCN Amplification Status | Shimada Histology | COG Risk Stratification | Years of Survival | All 37920 Clones Ave ANN Vote | Top 19 Genes Ave ANN Vote | ANN Predicted Outcome | Clinical Outcome |
|---|---|---|---|---|---|---|---|---|---|---|---|---|
| NB1[1] | 1998 | 2 | 0.3 | 1 | NA | F | L | 5.1 | – | 0.02 | A | A |
| NB2[2] | 1997 | 2 | 0.9 | 4 | NA | F | I | 5.9 | – | 0.02 | A | A |
| NB3[3] | 1998 | 2 | 1.2 | 4 | NA | F | H | 5.7 | – | 0.01 | A | A |
| NB4[4] | 1997 | 2 | 1.4 | 4 | NA | F | H | 6.7 | – | 0.02 | A | A |
| NB7 | 1998 | 2 | 1.3 | 1 | NA | – | L | 5.2 | 0.06 | 0.03 | A | A |
| NB14 | 2000 | 2 | 0.9 | 4 | AMP | – | H | 3.2 | 0.18 | 0.05 | A | A |
| NB15 | 1999 | 2 | 0.9 | 2 | NA | – | L | 3.9 | 0.03 | 0.02 | A | A |
| NB18 | 2000 | 2 | 1.8 | 2 | NA | – | L | 1.4 | 0.72 | 0.95 | D | D |
| NB21 | 2000 | 2 | 5.2 | 4 | AMP | – | H | 0.6 | 0.92 | 0.99 | D | D |
| NB27 | 2000 | 2 | 10.5 | 4 | AMP | UF | H | 1.4 | 0.36 | 0.97 | D | D |
| NB29[1] | 1998 | 2 | 0.3 | 1 | NA | F | L | 5.1 | 0.04 | 0.02 | A | A |
| NB30[2] | 1997 | 2 | 0.9 | 4 | NA | F | I | 5.9 | 0.05 | 0.01 | A | A |
| NB31[4] | 1997 | 2 | 1.4 | 4 | NA | F | H | 6.7 | 0.04 | 0.02 | A | A |
| NB32[3] | 1998 | 2 | 1.2 | 4 | NA | F | H | 5.7 | 0.05 | 0.02 | A | A |
| NB61 | 1997 | 2 | 1.4 | 3 | NA | F | I | 6.3 | 0.22 | 0.2 | A | A |
| NB69 | 1992 | 2 | 4.4 | 4 | NA | – | H | 0.5 | 0.16 | 0.8 | D | D |
| NB75 | 1998 | 2 | 1 | 3 | AMP | F | H | 3 | 0.89 | 0.99 | D | D |
| NB77 | 1994 | 2 | 0.2 | 1 | NA | – | L | 9.7 | 0.07 | 0.01 | A | A |
| NB79 | 1997 | 2 | 2.8 | 4 | AMP | – | H | 1.5 | 0.9 | 0.99 | D | D |
| NB205 | 1995 | 1 | 3.9 | 4 | NA | – | H | 2.3 | 0.52 | 0.84 | D | D |
| NB207[5] | 1995 | 1 | 4.4 | 4 | NA | – | H | 3.1 | – | 0.98 | D | D |
| NB208 | 1995 | 1 | 0.8 | 1 | NA | F | L | 4.8 | 0.11 | 0.02 | A | A |
| NB209[6] | 1995 | 1 | 1.2 | 4 | NA | UF | H | 1 | – | 0.98 | D | D |
| NB210[7] | 1996 | 1 | 2.3 | 4 | NA | UF | H | 1.1 | – | 0.97 | D | D |
| NB216 | 1996 | 1 | 0.6 | 3 | NA | – | I | 6.8 | 0.05 | 0.02 | A | A |
| NB231 | 1998 | 1 | 0.5 | 2 | NA | F | L | 4 | 0.04 | 0.02 | A | A |
| NB237 | 1999 | 1 | 4.1 | 1 | NA | F | L | 3.2 | 0.14 | 0.11 | A | A |
| NB254 | 2000 | 3 | 2.6 | 4 | AMP | – | H | 1.8 | 0.88 | 0.98 | D | D |
| NB255 | 1999 | 3 | 0.5 | 2 | NA | – | L | 4 | 0.71 | 0.24 | A | A |
| NB266 | 1996 | 3 | 2 | 4 | AMP | – | H | 0 | 0.63 | 0.98 | D | D |
| NB273[5] | 1995 | 1 | 4.4 | 4 | NA | – | H | 3.1 | 0.84 | 0.96 | D | D |
| NB275[6] | 1995 | 1 | 1.2 | 4 | NA | UF | H | 1 | 0.94 | 0.99 | D | D |

TABLE 4-continued

| NB276[7] | 1996 | 1 | 2.3 | 4 | NA  | UF | H | 1.1 | 0.57 | 0.98 | D | D |
|----------|------|---|-----|---|-----|----|---|-----|------|------|---|---|
| NB278    | 1999 | 1 | 1.7 | 4 | AMP | UF | H | 0.8 | 0.85 | 0.94 | D | D |
| NB283    | 1999 | 1 | 5.5 | 4 | NA  | UF | H | 4   | 0.45 | 0.9  | D | D |
| NB8      | 1998 | 2 | 4.6 | 4 | NA  | –  | H | 1.8 | 0.63 | 0.97 | D | D |
| NB9      | 1996 | 2 | 1.1 | 1 | NA  | –  | L | 7.1 | 0.04 | 0.02 | A | A |
| NB17     | 2000 | 2 | 1.2 | 1 | NA  | F  | L | 3.5 | 0.17 | 0.03 | A | A |
| NB24     | 2000 | 2 | 0.6 | 4 | NA  | F  | I | 3   | 0.08 | 0.03 | A | A |
| NB33     | 1998 | 2 | 1.4 | 1 | NA  | F  | L | 4.8 | 0.05 | 0.02 | A | A |
| NB34     | 1997 | 2 | 1.2 | 1 | NA  | F  | L | 5.2 | 0.04 | 0.02 | A | A |
| NB35     | 1997 | 2 | 2.6 | 4 | NA  | –  | H | 6.5 | 0.13 | 0.07 | A | A |
| NB64     | 1998 | 2 | 0.6 | 4 | NA  | –  | I | 5.6 | 0.81 | 0.02 | A | A |
| NB72     | 1994 | 2 | 3   | 3 | AMP | –  | H | 1   | 0.94 | 0.98 | D | D |
| NB201    | 1994 | 1 | 1.5 | 3 | NA  | UF | H | 7.4 | 0.04 | 0.08 | A | A |
| NB206    | 1995 | 1 | 3.3 | 4 | NA  | UF | H | 5.8 | 0.82 | 0.96 | D | D |
| NB215    | 1996 | 1 | 1.2 | 3 | NA  | F  | I | 7.3 | 0.04 | 0.03 | A | A |
| NB220    | 1997 | 1 | 0.4 | 2 | NA  | F  | L | 6   | 0.06 | 0.04 | A | A |
| NB221    | 1997 | 1 | 0.4 | 1 | NA  | F  | L | 5.7 | 0.09 | 0.02 | A | A |
| NB232    | 1998 | 1 | 0.1 | 2 | NA  | F  | L | 4.3 | 0.06 | 0.04 | A | A |
| NB235    | 1999 | 1 | 0.4 | 1 | NA  | F  | L | 3.2 | 0.15 | 0.03 | A | A |
| NB238    | 1999 | 1 | 1.2 | 1 | NA  | F  | L | 3   | 0.04 | 0.02 | A | A |
| NB251    | 2000 | 3 | 0.8 | 4 | AMP | –  | H | 0.5 | 0.69 | 0.91 | D | D |
| NB265    | 1996 | 3 | 1.8 | 4 | AMP | –  | H | 2   | 0.78 | 0.97 | D | D |
| NB269    | 1997 | 3 | 0.8 | 4 | NA  | –  | I | 5.3 | 0.04 | 0.07 | A | A |
| NB282    | 1999 | 1 | 4.6 | 4 | NA  | UF | H | 3.3 | 0.91 | 0.58 | D | A |

All samples (except NB1, NB2, NB3, NB4, NB207, NB209 and NB210) were used in the leave-one-out ANN analysis. Samples highlighted in gray are the 21 test samples, and the rest were used for training during the clone optimization procedure. There were 7 replicated samples, marked by the numbers in superscript.

Sample Source: 1=Cooperative Human Tissue Network (CHTN, Ohio, USA); 2=German Cancer Research Center (GCRC); 3=The Children's Hospital at Westmead (CHW, Australia).

INSS=International Neuroblastoma Staging System.

MYCN amplification status: AMP=amplification; NA=not amplified.

Shimada Histology: F=favorable, "–"=not known, UF=unfavorable.

COG risk stratification: H=high-risk; I=intermediate-risk; L=low-risk.

Ave. ANN Vote=average ANN committee votes.

ANN prediction: average ANN vote <0.5=A (alive); >0.5=D (dead).

Clinical Outcome: A=alive without event; D=deceased due to NB disease.

Pre-treatment tumor samples were snap-frozen in liquid nitrogen following removal from the patients. Tumors were diagnosed as NB by local centers experienced in the management of these cancers. Additionally, the 56 samples were confirmed to be NBs by ANNs using the previously-identified NB-specific gene expression profiles, shown in the examples above. Patients were divided into two outcome groups: "good-outcome" group had event-free survival (i.e. neither relapse nor NB progression) for at least 3 years (n=30), and "poor-outcome" died due to NB disease (n=19). The median age for the good-outcome group was 0.9 years (range from 0.1 to 4.6 years) and for the poor-outcome group was 2.8 years (range from 0.8 to 10.5 years) (Table 4).

Total RNA was extracted from the frozen pre-treatment tumor samples using a previously published method (Wei, J. S, and Khan, J. Purification of Total RNA from Mammalian Cells and Tissues. In: D. Bowtell and J. Sambrook (eds.), DNA Microarrays: A Molecular Cloning Manual, pp. 110-119. Cold Spring Harbor, N.Y.: Cold Spring Harbor Laboratory Press, 2002). An Agilent BioAnalyzer 2100 (Agilent, Palo Alto, Calif.) was used to assess the integrity of total RNAs from the tumor samples. Total RNA from seven human cancer cell lines (CHP212, RD, Hela, A204, K562, RDES and CA46) was pooled in equal portions to constitute a reference RNA, which was used in all cDNA microarrray experiments.

Messenger RNA was amplified one round using a modified Eberwine RNA amplification procedure (Sotiriou, C., Khanna, C., Jazaeri, A. A., Petersen, D., and Liu, E. T. Core biopsies can be used to distinguish differences in expression profiling by cDNA microarrays. J Mol Diagn, 4: 30-36, 2002). Next, an indirect fluorescent labeling method was used to label cDNA (Hegde, P., Qi, R., Abernathy, K., Gay, C., Dharap, S., Gaspard, R., Hughes, J. E., Snesrud, E., Lee, N., and Quackenbush, J. A concise guide to cDNA microarray analysis. Biotechniques, 29: 548-550, 552-544, 556 passim., 2000) wherein, aminoallyl-dUTP (Sigma-Aldrich, St. Louis, Mo.) was first incorporated into cDNA in a reverse transcription reaction in which amplified anti-sense RNA was converted into cDNA by Superscript II reverse transcriptase enzyme (Invitrogen, Grand Island, N.Y.) according to the manufacturer's instructions. Second, unincorporated aminoallyl-dUTP was removed with Qiagen PCR purification kits (Qiagen, Valencia, Calif.) according to the manufacturer's instructions. Third, monoreactive-Cye5 or Cye3 dyes (AmershamPharmacia, Piscataway, N.J.) were conjugated with the aminoallyl-dUTP on the cDNA. Fluorescent-labeled cDNA was purified with Qiagen PCR purification kits.

The DNA microarrays were fabricated from sequence-verified cDNA libraries purchased from Research Genetics (Huntsville, Ala.). The library consisted of a total of 42578 cDNA clones, representing 25933 Unigene clusters (13606 known genes and 12327 unknown ESTs). The cDNA were printed on microarrays using a BioRobotics MicroGrid II spotter (Harvard Bioscience, Holliston, Mass.). Fabrication, hybridization and washing of microarrays were performed as described above in Example 1. Images were acquired by an Agilent DNA microarray scanner (Agilent, Palo Alto, Calif.), and analyzed using the Microarray Suite program, coded in IPLab (Scanalytics, Fairfax, Va.).

Gene expression ratios between the tumor sample RNA and the reference RNA on each microarray were normalized using a pin-based normalization method modified from Chen et al (Chen, Y., Dougherty, E. R., and Bittner, M. L. Ratio-based decisions and the quantitative analysis of cDNA microarray images. Biomedical Optics., 2: 364-374, 1997). In order to include only high quality data in the analysis, the quality of each individual cDNA spot was calculated according to Chen et al (Chen, Y., Kamat, V., Dougherty, E. R., Bittner, M. L., Meltzer, P. S., and Trent, J. M. Bioinformatics, 18:1207-1215, 2002). Next, spots with an average quality, across all samples, of less than 0.95 were excluded from the analysis. There were 37920 (90.3%) clones that passed this quality filter.

Feed-forward resilient back-propagation multi-layer perceptron ANNs (coded in Matlab, The Mathworks, Natick, Mass.) with 3 layers were used. The three layers were: an input layer of the top 10 principal components (PCs) of the data (FIGS. 4A and B) or the gene expression ratios of each cDNA spot (for the minimized gene set, see FIG. 4B); a hidden layer with 3 nodes; and an output layer generating a committee vote that discriminates two classes (i.e., good- and poor-outcome groups).

Average ANN committee votes were used to classify samples, and 0.5 was used as the decision boundary for ANN prediction throughout the study. The ideal vote was 0 for the good-outcome group (alive), and 1 for the poor-outcome group (dead). The ANNs were trained and used to predict NB outcomes using an 8-fold cross validation scheme in all analyses similar as described above.

A leave-one-out prediction strategy was performed first (FIG. 4A), where each sample (out of the 49 unique samples) was left out one time during the training of the ANNs, and the left out sample was then tested as an independent sample to predict the outcomes with all quality-filtered clones (n=37920) without further clone selection.

Figure 5A:
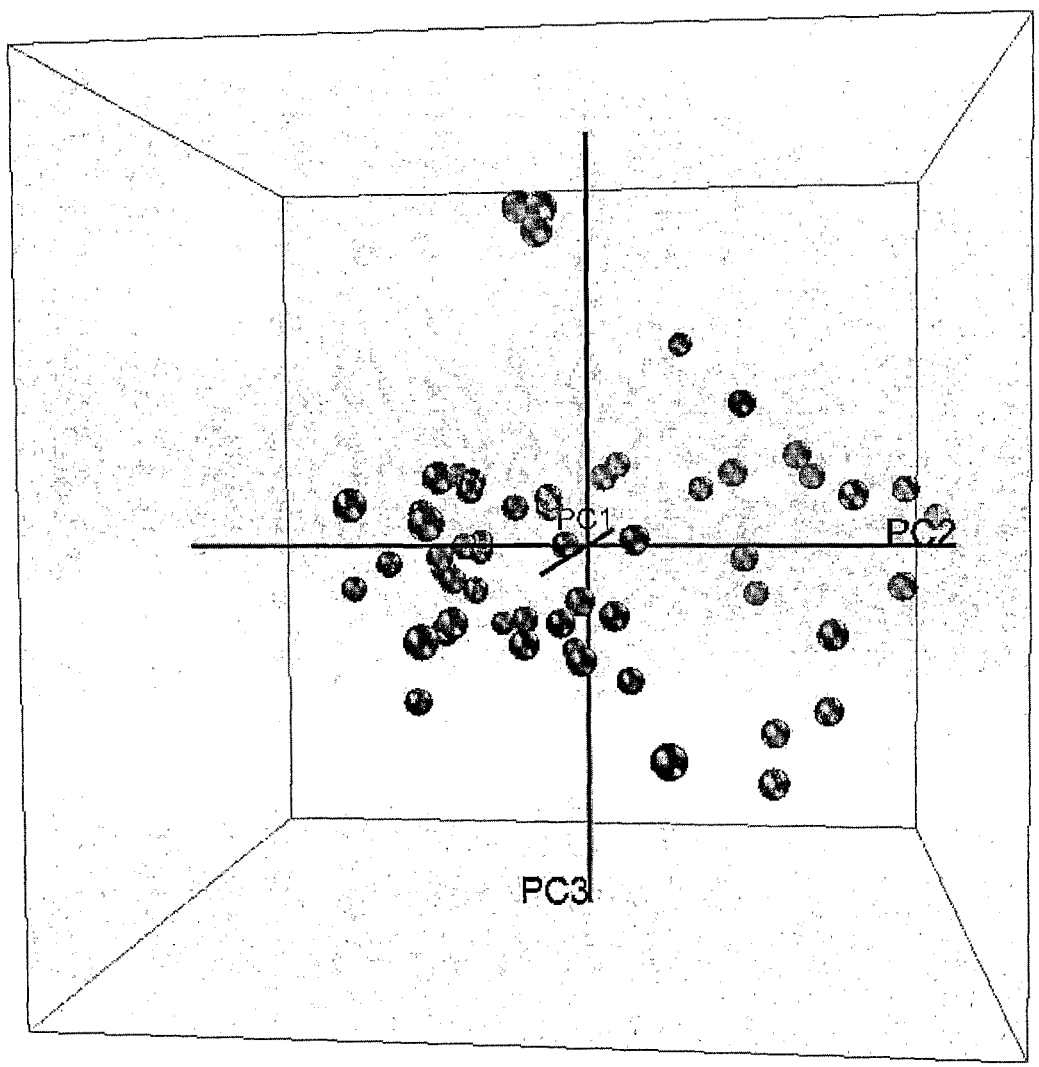
FIGS. 5A, B, C, and D depict (A) a plot of the top 3 principal components (PCs) of the 56 NB samples using all quality-filtered 37920 clones—when the figure is viewed from a point of view facing the figure, spheres located in the upper and lower right quadrants represent for the most part poor-outcome patients, while spheres located in the upper and lower left quadrants represent for the most part good-outcome patients; (B) ANN voting results for outcome prediction of the 49 unique NB patients using 37920 clones without any further clone selection in a leave-one-out prediction scheme (Samples labels; St=stage, NA=MYCN non-amplified, A=MYCN amplified, followed by sample name) Symbols represent ANN average committee votes for each sample, while the length of the horizontal lines represents the standard error—triangles represent poor-outcome, and circles represent good-outcome NBs. Vertical line at 0.5 is the decision boundary for outcome prediction (i.e., good signature<0.5, poor signature>0.5); (C) Kaplan-Meier curves of survival probability for the 49 NB patients derived from the results in FIG. 5B; and (D) Kaplan-Meier curves of survival probability for the 49 NB patients using the current COG risk stratification.
Figure 5B:
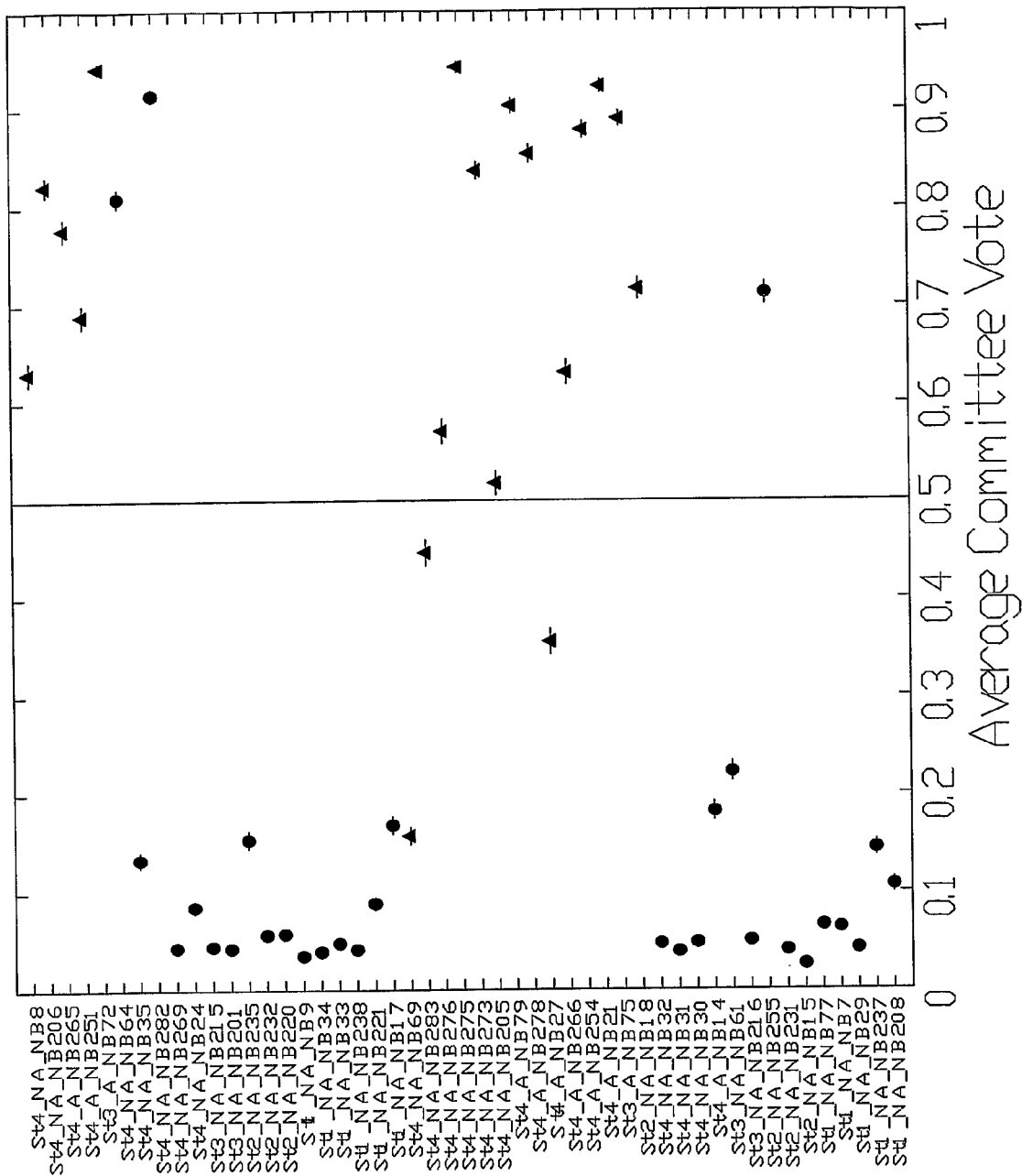

Visualization of all 56 NB samples using principal component analysis (PCA) of all quality-filtered 37920 clones revealed NB samples generally grouped according to their clinical outcomes (FIG. 5A), clearly indicating a pre-existent prognostic signature. The ability of ANNs to predict prognosis of the 49 unique individuals was then tested (excluding 7 replicated samples) with all 37920 clones using a conservative unbiased leave-one-out prediction strategy (FIG. 4A). The ANNs correctly predicted 16/19 poor-outcome and 27/30 good-outcome cases (FIG. 5B). This corresponds to a sensitivity of 84% and specificity of 90% for the poor-outcome patients, with a positive predictive value of 84% for the poor- and 90% for the good-outcome patients (Table 5).

TABLE 5

Performance of ANN prediction

| ANN Prediction | Sensitivity (%) (poor-outcome) | Specificity (%) (poor-outcome) | Positive predictive value (%) (poor-outcome) | Positive predictive value (%)(good-outcome) |
|---|---|---|---|---|
| Leave-one-out with all clones (n = 49) | 84 | 90 | 84 | 90 |

The average ANN vote, the ANN predicted outcome of the patient, and the clinical outcome of the NB patients is also summarized in Table 6 below.

TABLE 6

ANN predicted results and Clinical outcome of NB Patients

| Sample label | All 37920 Clones Ave ANN Vote | Top 19 Genes Ave ANN Vote | ANN Predicted Outcome | Clinical Outcome |
|---|---|---|---|---|
| NB1[1] | – | 0.02 | A | A |
| NB2[2] | – | 0.02 | A | A |
| NB3[3] | – | 0.01 | A | A |
| NB4[4] | – | 0.02 | A | A |
| NB7 | 0.06 | 0.03 | A | A |
| NB14 | 0.18 | 0.05 | A | A |
| NB15 | 0.03 | 0.02 | A | A |
| NB18 | 0.72 | 0.95 | D | D |
| NB21 | 0.92 | 0.99 | D | D |
| NB27 | 0.36 | 0.97 | D | D |
| NB29[1] | 0.04 | 0.02 | A | A |
| NB30[2] | 0.05 | 0.01 | A | A |
| NB31[4] | 0.04 | 0.02 | A | A |
| NB32[3] | 0.05 | 0.02 | A | A |
| NB61 | 0.22 | 0.2 | A | A |
| NB69 | 0.16 | 0.8 | D | D |
| NB75 | 0.89 | 0.99 | D | D |
| NB77 | 0.07 | 0.01 | A | A |
| NB79 | 0.9 | 0.99 | D | D |
| NB205 | 0.52 | 0.84 | D | D |
| NB207[5] | – | 0.98 | D | D |
| NB208 | 0.11 | 0.02 | A | A |
| NB209[6] | – | 0.98 | D | D |
| NB210[7] | – | 0.97 | D | D |
| NB216 | 0.05 | 0.02 | A | A |
| NB231 | 0.04 | 0.02 | A | A |
| NB237 | 0.14 | 0.11 | A | A |
| NB254 | 0.88 | 0.98 | D | D |
| NB255 | 0.71 | 0.24 | A | A |
| NB266 | 0.63 | 0.98 | D | D |
| NB273[5] | 0.84 | 0.96 | D | D |
| NB275[6] | 0.94 | 0.99 | D | D |
| NB276[7] | 0.57 | 0.98 | D | D |
| NB278 | 0.85 | 0.94 | D | D |
| NB283 | 0.45 | 0.9 | D | D |
| NB8 | 0.63 | 0.97 | D | D |
| NB9 | 0.04 | 0.02 | A | A |
| NB17 | 0.17 | 0.03 | A | A |
| NB24 | 0.08 | 0.03 | A | A |
| NB33 | 0.05 | 0.02 | A | A |
| NB34 | 0.04 | 0.02 | A | A |
| NB35 | 0.13 | 0.07 | A | A |
| NB64 | 0.81 | 0.02 | A | A |
| NB72 | 0.94 | 0.98 | D | D |
| NB201 | 0.03 | 0.08 | A | A |
| NB206 | 0.82 | 0.96 | D | D |
| NB215 | 0.04 | 0.03 | A | A |
| NB220 | 0.06 | 0.04 | A | A |
| NB221 | 0.09 | 0.02 | A | A |
| NB232 | 0.06 | 0.04 | A | A |
| NB235 | 0.15 | 0.03 | A | A |
| NB238 | 0.04 | 0.02 | A | A |
| NB251 | 0.69 | 0.91 | D | D |
| NB265 | 0.78 | 0.97 | D | D |
| NB269 | 0.04 | 0.07 | A | A |
| NB282 | 0.91 | 0.58 | D | A |

Survival length was calculated for the 49 unique NB patients from date of diagnosis until date of death or last follow-up as appropriate. The probability of survival and significance were calculated using the Kaplan-Meier and Mantel-Haenszel methods, respectively (Kaplan, E. and Meier, P. Non-Parametric Estimation from Imcomplete Observations. J. Am. Stat. Assoc., 53: 457-481, 1958; and Mantel, M. Evaluation of Survival Data and Two New Rank Order Statistics Arising in its Consideration. Cancer Chem. Rep., 50: 163-170, 1966).

Figure 5C:
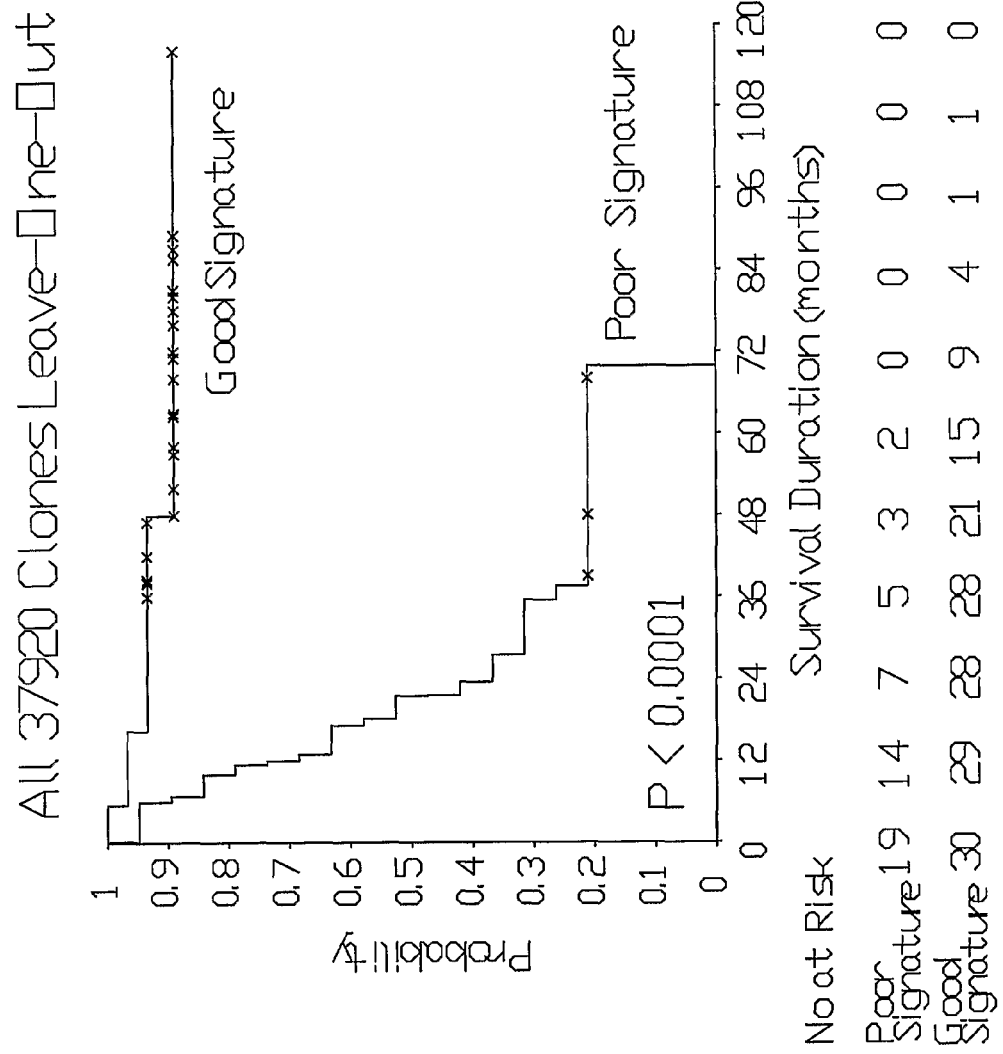

The Kaplan-Meier curves demonstrated that patients with poor and good gene expression signatures as identified by the ANNs had significantly different survival probabilities (P<0.0001 see FIG. 5C).

The Cox proportional hazards model (Cox, D. Regression Models and Life Tables. J. Royal Stat. Soc. (B), 34: 187-202, 1972) was used to determine the hazard ratios and confidence intervals (Matthews, D. E. and Farewell, V. T. Using and Understanding Medical Statistics. In, 3rd edition edition, pp. 150-160. Basel: Karger, 1996) for survival between the dichotomized groups of patients, and was used to assess which factors were jointly significant in the association with survival for the 24 high-risk patients (Cox et al.).

The Cox model parameters ($b_i$) were converted to hazard ratios by computing $\exp(b_i)$, where $\exp(a)=2.7183^a$. The 95% confidence interval for the hazard ratio was computed as [$\exp(b_{iL})$, $\exp(b_{iH})$] where $b_{iL}=b_i-1.96$ [estimated standard error ($b_i$)] and $b_{iH}=b_i+1.96$ [estimated standard error ($b_i$)] (Matthews et al.). In this study, the hazard ratio indicates the risk associated with NB-caused death while being in a greater-risk category compared to that of being in the lower-risk category. Using the procedure described by Simon and Altman, a likelihood ratio test was used to assess for importance of the microarray prediction after adjusting for standard prognostic factors such as MYCN amplification, age, or stage (Simon, R. and Altman, D. G. Statistical aspects of prognostic factor studies in oncology. Br J Cancer, 69: 979-985, 1994).

Figure 5D:
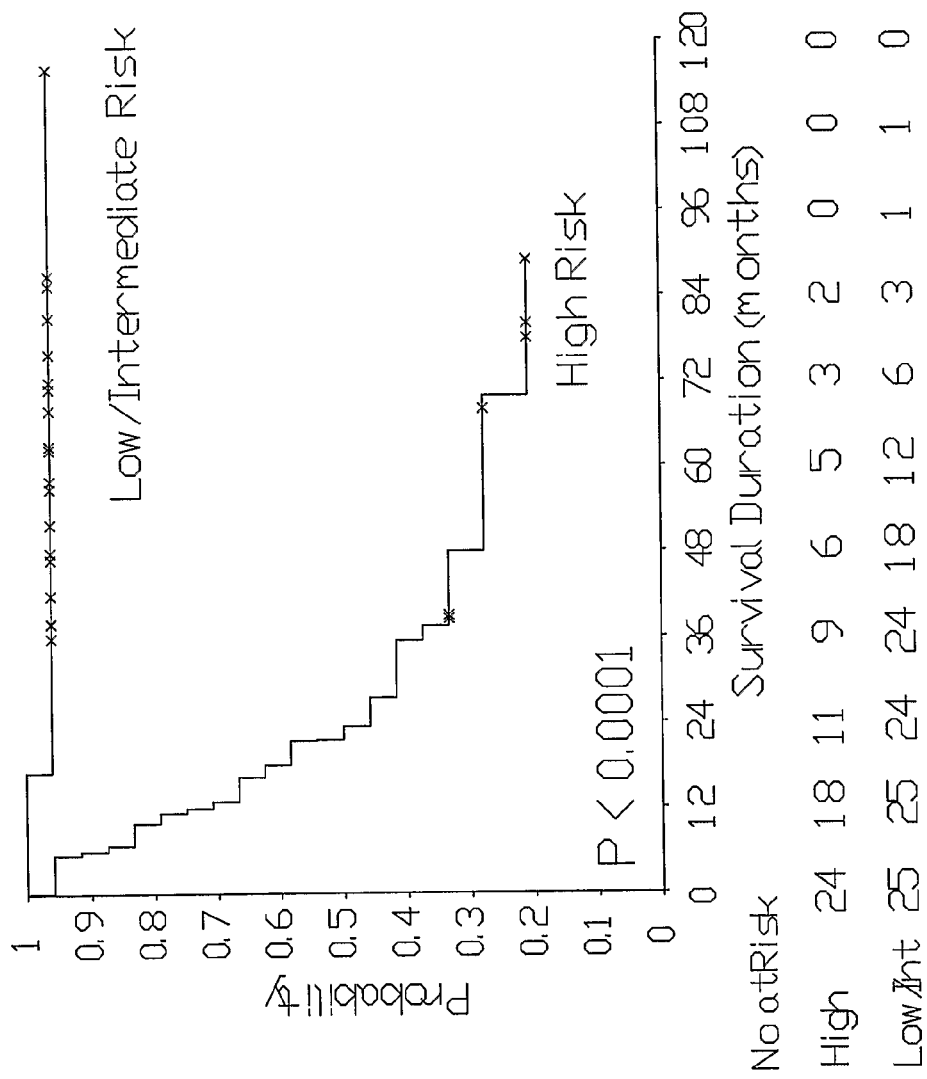

The Cox proportional hazard ratio for the risk of death associated with the poor signature was 16.1 (95% confidence interval: 4.6-56.9, P<0.0001), which was higher than those of all the other risk factors we examined (stage, MYCN amplification, age) except Shimada Histology, and was comparable to the COG risk stratification (Table 7 and FIG. 5D).

The Cox proportional hazards model was used to calculate all hazard ratios (H.R.) and confidence intervals (C.I.). P-values were calculated using the Mantel-Haenszel method.

These hazard ratios are infinite because none of the patients predicted to have good-outcome experienced an event (i.e., death).

Example 4

Optimization of Genes Used for NB Clinical Outcome Prediction

To identify the optimal set of genes that results in the minimum classification errors a gene minimization procedure was performed as exemplified above. All 56 samples were randomly partitioned into training (n=35) and testing sets (n=21) and the training set was used for the gene selection algorithm.

Figure 6A:
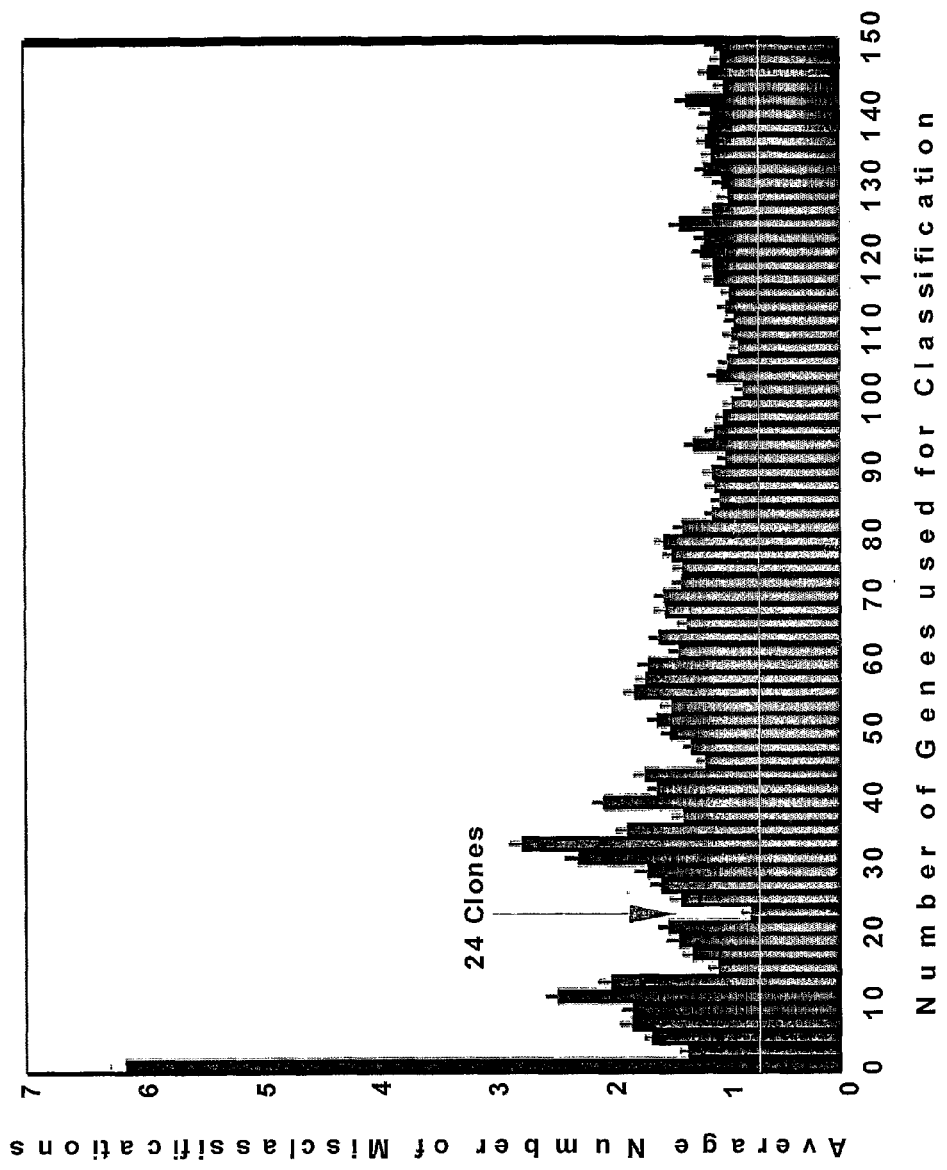
FIGS. 6A, B, C, and D depict (A) clone minimization plot for ANN prediction; (B) plot of the top 3 principal components (PCs) of the 56 NB samples using the top 19 genes (duplicated clones of the same gene were removed, and the top-ranked clone for each gene was used in the ANN prediction)—when the figure is viewed from the point of view facing the figure, spheres located in the upper and lower right quadrants for the most part represent poor-outcome patients, while spheres located in the upper and lower left quadrants for the most part represent good-outcome patients; (C) ANN committee vote results of the 56 samples using the top 19 ANN-ranked genes—the horizontal dotted line divides the test (above the line) from the training samples, triangles are poor outcome, circles are good outcome; and (D) The Kaplan-Meier curves for survival probability of the 49 patients were derived from the ANN prediction using the 19 genes in FIG. 6C.

From this, it was observed that the top 24 ANN-ranked clones resulted in the minimal classification error (FIG. 6A). The top-ranked clone for each gene was taken and this set of genes was used as a minimal gene set. These 24 clones represented 19 unique genes as shown in Table 2.

Figure 6B:
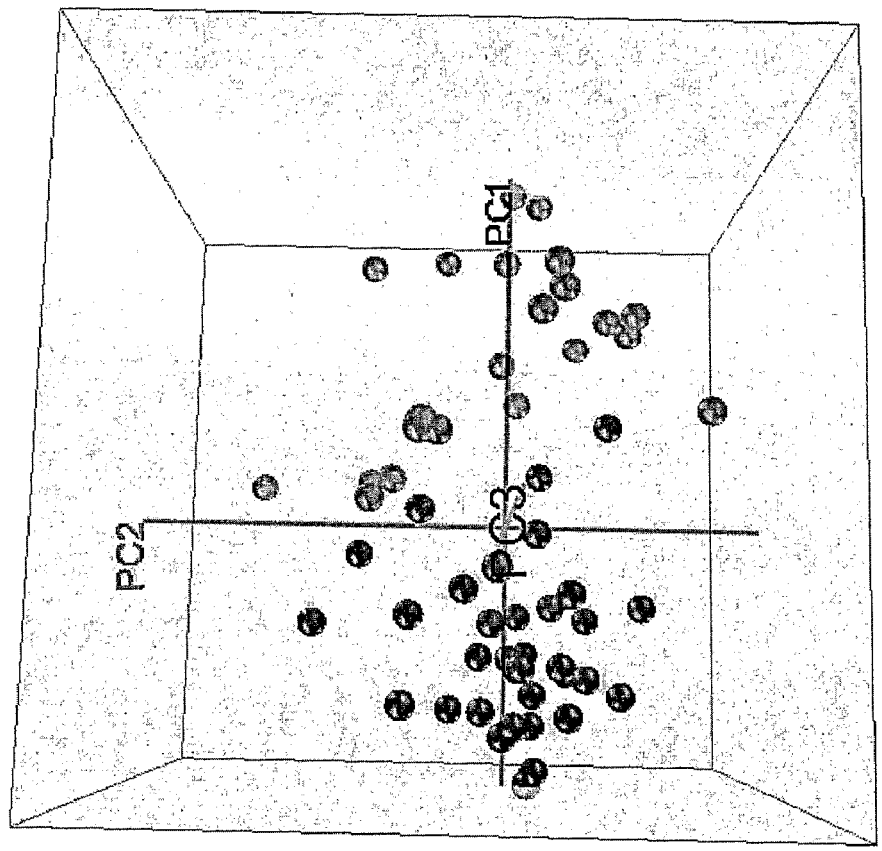

The top-ranked clone for each gene was taken and this set of genes was used as a minimal gene set. When the overall variance of these genes was visualized using PCA on all 56 samples a clearer separation of the poor- from the good-outcome samples (in comparison to that observed with the PCA for all 37920 clones) (FIG. 6B compared to FIG. 5A).

Figure 6C:
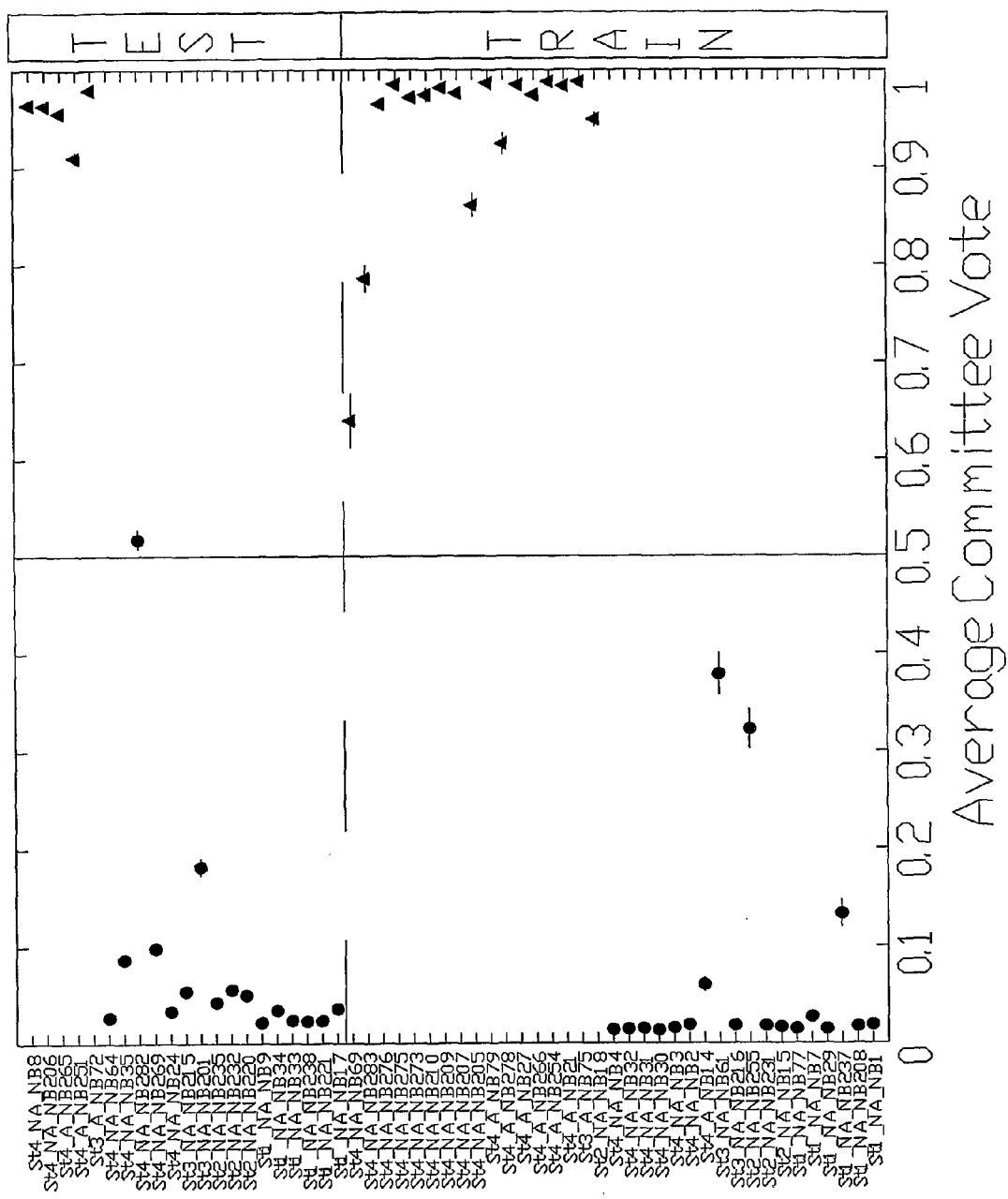

The ANN was then recalibrated with the 35 training samples using the expression ratios for the 19 genes and correctly predicted the outcomes for 5/5 poor-outcome and 15/16 good-outcome patients in the independent test set, corresponding to a sensitivity of 100% and a specificity of 94% for predicting poor-outcome (FIG. 6C and Table 8). The positive predictive values were 83% and 100% for the poor- and good-outcome groups, respectively for the test samples, and 95% and 100% for all patients (Table 8).

TABLE 7

Univariate Proportional Hazard Analysis for the Risk of NB-related Death

| Variable | H.R. | 95% C.I. | Log-Rank P Value |
|---|---|---|---|
| All NB Samples (n = 49) | | | |
| All 37920 Clones (Poor signature vs. Good signature) | 16.1 | (4.6-56.9) | <0.0001 |
| Top 19 ANN-Ranked Genes (Poor signature vs. Good signature) | ∞* | — | <0.0001 |
| COG risk stratification (High Risk vs. Low & Intermediate Risk) | 29.7 | (4.0-222.9) | <0.0001 |
| COG risk stratification (High & Intermediate Risk vs. Low Risk) | 13.6 | (1.8-101.7) | 0.0009 |
| COG risk stratification (High Risk vs. Low Risk) | 23.2 | (3.1-175.9) | <0.0001 |
| INSS Stage (Stage 4 vs. Stages 1-3) | 7.1 | (2.1-24.2) | 0.0003 |
| INSS Stage (Stage 3 & 4 vs. Stage 1 & 2) | 13.6 | (1.8-101.7) | 0.0009 |
| MYCN status (amplified vs. not amplified) | 9.8 | (3.6-26.7) | <0.0001 |
| Age (>1 yr vs. <1 yr) | 12.3 | (1.6-92.5) | 0.0017 |
| Shimada Histology (unfavorable vs. favorable) (n = 27) | 19.9 | (2.4-166.1) | 0.0001 |
| High Risk Samples (n = 24) | | | |
| MYCN status (amplified vs. not amplified) | 3.5 | (1.2-10.0) | 0.01 |
| Top 19 ANN-Ranked Genes (Poor signature vs. Good signature) | ∞* | — | 0.0005 |
| All 37920 Clones (Poor signature vs. Good signature) | 5.3 | (1.4-19.4) | 0.0067 |

TABLE 8

Performance of ANN prediction

| ANN Prediction | Sensitivity (%) (poor-outcome) | Specificity (%) (poor-outcome) | Positive predictive value (%) (poor-outcome) | Positive predictive value (%) (good-outcome) |
|---|---|---|---|---|
| 19 Genes (Test samples: n = 21) | 100 | 94 | 83 | 100 |
| 19 Genes (n = 49) | 100 | 97 | 95 | 100 |

Figure 6D:
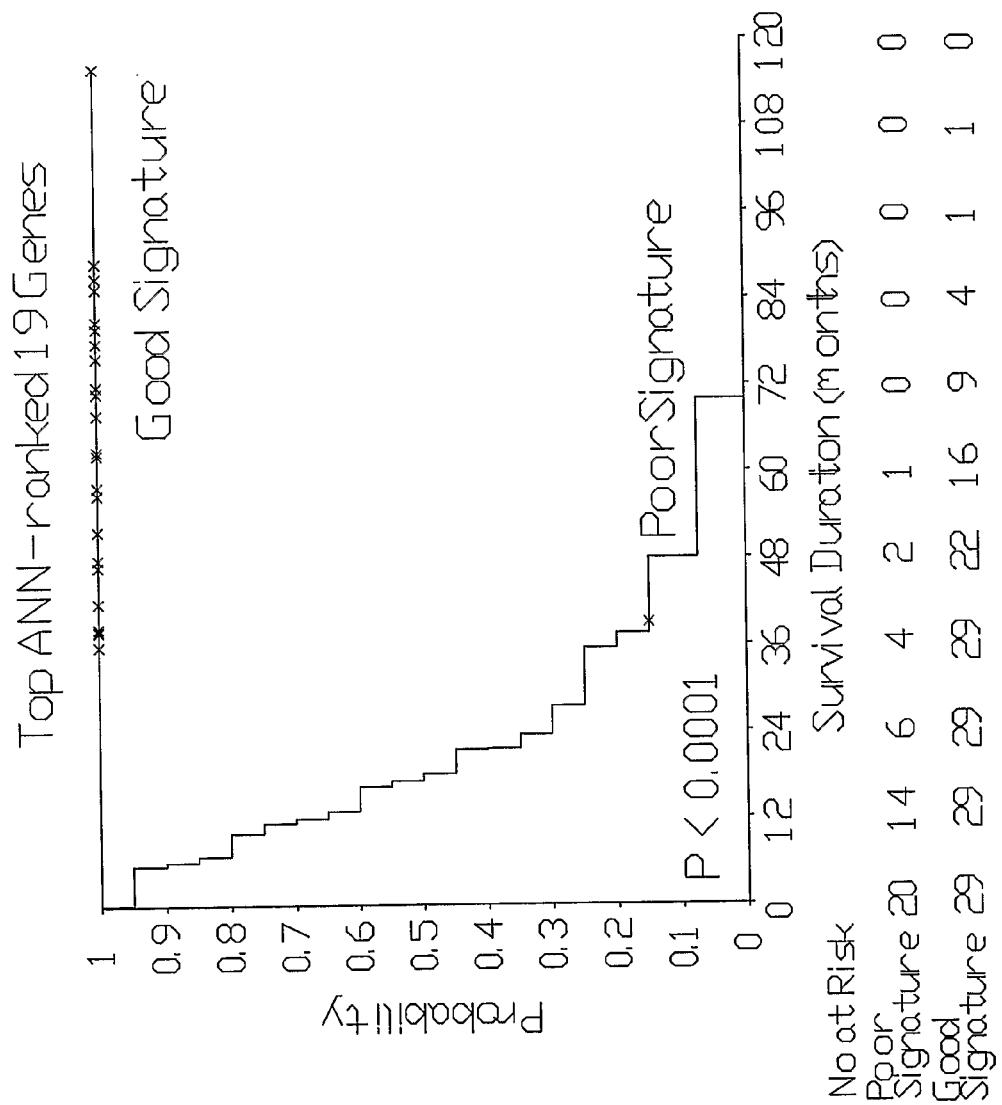

The Kaplan-Meier curves demonstrated that patients with good and poor signatures based on the expression ratios of the 19 genes had significantly different survival probabilities (P<0.0001 see FIG. 6D). Furthermore, no patients died in the good signature group, thus the hazard ratio for death risk was infinite (Table 8).

The top 24 ANN-ranked clones represent 19 UniGene clusters of 12 known genes and 7 ESTs, as DLK1, ARHI, PRSS3, and SLIT3 were represented by multiple cDNA clones (FIG. 7A). Nine of the genes were up regulated and 10 down regulated in the poor- compared to the good-outcome group (FIG. 7, A and B). To our knowledge, all of the genes, except MYCN and CD44, have not been previously associated with NB prognosis.

The expression data presented in FIG. 7A, as well as additional expression data for the top ranked 250 genes is described in Tables 9A, B, C. Whether the gene expression is upregulated or downregulated in poor outcome patients in shown in Table 3. Expression level of each gene was logged (base$^2$) and mean centered. Table 9A provides expression data from the top 250 genes in good outcome patients used for training for ANNs. Table 9B provides expression data for top 250 genes in poor outcome patients used for training ANNs. Table 9C shows the expression data in the test samples from good and poor outcome patients.

TABLE 9A

| | | Training Samples: Good outcome patients. (1$^{st}$ bar FIG. 7A) | | | | | |
|---|---|---|---|---|---|---|---|
| Rank | Gene | St1_NA_NB1 | St1_NA_NB208 | St1_NA_NB237 | St1_NA_NB29 | St1_NA_NB7 | St1_NA_NB77 |
| 1 | DLK1 | 0.11 | 0.66 | 0.3 | 0.03 | 0.12 | 0.16 |
| 2 | est | 0.18 | 0.39 | 0.57 | 0.35 | 0.68 | 0.25 |
| 3 | PRSS3 | 5.12 | 1.16 | 3.4 | 2.61 | 0.78 | 3.9 |
| 4 | ARHI | 1.32 | 17.3 | 5.13 | 1.19 | 17.3 | 6.56 |
| 5 | ARC | 2.21 | 5.4 | 4.73 | 1.56 | 3.97 | 2.18 |
| 6 | SLIT3 | 24.97 | 15.98 | 16.59 | 11.54 | 10.29 | 27.14 |
| 7 | CNR1 | 16.23 | 9.34 | 4.62 | 17.56 | 11.15 | 19.41 |
| 8 | est | 0.24 | 0.42 | 0.69 | 0.2 | 0.12 | 0.23 |
| 9 | est | 2.18 | 1.21 | 2.13 | 1.61 | 2.56 | 1.88 |
| 10 | FLJ25461 | 0.8 | 1.91 | 1.7 | 1.11 | 4.52 | 1.01 |
| 11 | est | 0.24 | 0.68 | 0.4 | 0.39 | 0.36 | 0.34 |
| 12 | CD44 | 4.39 | 2.25 | 2.94 | 3.8 | 1.69 | 3.68 |
| 13 | est | 0.25 | 2.48 | 0.37 | 0.42 | 2.01 | 0.87 |
| 14 | ROBO2 | 3.18 | 16.42 | 0.75 | 3.12 | 5.5 | 3.18 |
| 15 | BTBD3 | 0.87 | 1.62 | 0.61 | 0.99 | 2.87 | 1.58 |
| 16 | MYCN | 9.53 | 9.94 | 0.87 | 7.34 | 6.44 | 3.01 |
| 17 | est | 5.59 | 8.52 | 11.48 | 7.3 | 9.8 | 30.93 |
| 18 | JPH1 | 0.04 | 0.05 | 0.12 | 0.07 | 0.15 | 0.05 |
| 19 | KLRC3 | 0.06 | 0.15 | 0.06 | 0.11 | 0.08 | 0.05 |
| 20 | est | 3.92 | 22.55 | 39.56 | 1.91 | 6.6 | 3.17 |
| 21 | RET | 0.88 | 1.33 | 18.4 | 0.93 | 8.86 | 4.15 |
| 22 | CRABP1 | 0.06 | 0.12 | 0.11 | 0.13 | 0.53 | 0.05 |
| 23 | ECEL1 | 2.12 | 2.17 | 0.27 | 2.08 | 1.88 | 2.24 |
| 24 | LOC283120 | 1 | 1 | 1.03 | 0.92 | 0.8 | 15.84 |
| 25 | HMGA2 | 8.72 | 24.37 | 5.71 | 10.85 | 10.48 | 20.86 |
| 26 | SYNPO2 | 9.47 | 12.41 | 33.16 | 5.35 | 4.54 | 14.85 |
| 27 | LOC163782 | 0.19 | 0.23 | 1.45 | 0.2 | 0.41 | 0.22 |
| 28 | VSNL1 | 1.9 | 35.23 | 7.52 | 2.47 | 7.76 | 14.01 |
| 29 | HS3ST4 | 0.11 | 0.49 | 0.11 | 0.15 | 0.14 | 0.09 |
| 30 | AKR1C1 | 0.57 | 0.22 | 0.52 | 0.41 | 0.33 | 0.42 |
| 31 | est | 0.7 | 9.95 | 0.77 | 0.04 | 10.97 | 0.26 |
| 32 | GPR22 | 7.71 | 4.56 | 7.88 | 22.63 | 23.98 | 5.08 |
| 33 | est | 1.27 | 1.75 | 3.82 | 1.07 | 2.96 | 1.58 |
| 34 | est | 0.15 | 0.21 | 0.29 | 0.11 | 0.05 | 0.21 |
| 35 | CCNA1 | 1.43 | 6.2 | 4.96 | 1.18 | 3.66 | 1.22 |
| 36 | PKIB | 3.76 | 8.15 | 17.22 | 3.01 | 0.57 | 13.21 |
| 37 | est | 0.84 | 1.9 | 1.97 | 0.95 | 2.35 | 1.01 |
| 38 | GAL | 0.3 | 0.41 | 0.64 | 0.17 | 0.08 | 0.17 |
| 39 | est | 0.88 | 0.43 | 11.1 | 1.11 | 3.23 | 0.39 |
| 40 | LOC221303 | 2.59 | 1.87 | 22.22 | 1.75 | 2.17 | 16.05 |
| 41 | est | 5.5 | 2.36 | 2.66 | 2.08 | 1.31 | 3.71 |
| 42 | est | 1.07 | 6.12 | 3.3 | 1.17 | 0.82 | 2.34 |
| 43 | BMP7 | 8.84 | 0.29 | 4.47 | 4.94 | 1.81 | 0.36 |
| 44 | SLC30A3 | 0.47 | 1.39 | 0.46 | 0.62 | 1.04 | 0.38 |
| 45 | FLJ10539 | 1.77 | 1.31 | 0.32 | 2.46 | 0.58 | 1.24 |
| 46 | AMIGO2 | 6.36 | 0.42 | 2.6 | 6.26 | 8.21 | 4.79 |
| 47 | AKR1C2 | 0.53 | 0.24 | 0.61 | 0.55 | 0.38 | 0.5 |
| 48 | MGP | 0.37 | 0.07 | 0.06 | 0.04 | 0.16 | 0.72 |
| 49 | PCSK1 | 0.19 | 0.2 | 0.4 | 0.26 | 0.36 | 0.46 |
| 50 | HK2 | 0.34 | 0.26 | 0.27 | 0.18 | 0.19 | 0.18 |
| 51 | est | 0.33 | 0.57 | 0.38 | 0.53 | 0.7 | 0.44 |
| 52 | est | 0.43 | 0.34 | 0.32 | 0.49 | 0.39 | 0.28 |
| 53 | IL7 | 5.72 | 8.26 | 0.74 | 12.92 | 6.4 | 8.2 |
| 54 | PRSS12 | 0.7 | 1.58 | 1.64 | 0.81 | 0.56 | 1.09 |
| 55 | GABARAPL1 | 2.2 | 0.8 | 3.35 | 1.33 | 1.41 | 1.4 |
| 56 | DEFB129 | 0.64 | 1.72 | 0.63 | 0.74 | 1.1 | 0.57 |
| 57 | NAV3 | 0.43 | 4.97 | 4.85 | 0.51 | 3.67 | 6.35 |
| 58 | RAB3B | 17.91 | 25.84 | 21.5 | 9.84 | 21.21 | 16.71 |
| 59 | KRT6B | 0.63 | 1.47 | 2.13 | 3.23 | 2.22 | 2.58 |
| 60 | BEX1 | 24.41 | 21.74 | 17.54 | 15.56 | 40.05 | 16.52 |
| 61 | est | 28.76 | 23.52 | 16.38 | 12.76 | 38.4 | 15.28 |
| 62 | est | 0.47 | 1.25 | 0.38 | 0.52 | 1.94 | 2.93 |
| 63 | SCYL1 | 4.83 | 6.49 | 3.29 | 5.77 | 5.1 | 3.44 |
| 64 | est | 1.24 | 8.63 | 1.92 | 1.1 | 4.44 | 3.78 |
| 65 | RYR2 | 7.65 | 37.67 | 6.75 | 8.2 | 14.93 | 8.05 |
| 66 | LRBA | 0.79 | 0.37 | 0.63 | 0.79 | 0.45 | 0.31 |
| 67 | CSPG3 | 0.49 | 4.53 | 1.2 | 0.41 | 1.44 | 0.79 |
| 68 | est | 3.1 | 2.39 | 2.66 | 4.04 | 4.32 | 1.49 |
| 69 | MMP12 | 1.04 | 15.51 | 3.22 | 1.04 | 2.09 | 4.03 |
| 70 | CHRNA1 | 0.03 | 0.02 | 0.02 | 0.04 | 0.03 | 0.04 |

TABLE 9A-continued

Training Samples: Good outcome patients. (1st bar FIG. 7A)

| | | | | | | | |
|---|---|---|---|---|---|---|---|
| 71 | est | 1.54 | 14.04 | 5.88 | 1.75 | 2.07 | 1.92 |
| 72 | est | 24.74 | 74.3 | 7.5 | 37.92 | 44.69 | 8.5 |
| 73 | HNRPH1 | 50.66 | 6.09 | 4.21 | 11.84 | 19.57 | 33.39 |
| 74 | LOC113251 | 1.16 | 2.01 | 0.32 | 1.99 | 1.9 | 0.79 |
| 75 | est | 4.46 | 5.41 | 0.99 | 2.44 | 3.9 | 1.25 |
| 76 | PAG | 4.89 | 6.31 | 2.91 | 5.67 | 3.87 | 3.41 |
| 77 | PROK2 | 6.55 | 24.79 | 2.83 | 6.59 | 11 | 5.89 |
| 78 | HS6ST1 | 1.68 | 6.89 | 5.81 | 1.78 | 4.15 | 1.63 |
| 79 | est | 3.05 | 10.82 | 2.94 | 10.94 | 8.33 | 3.02 |
| 80 | PCDH9 | 1.54 | 14.65 | 14.09 | 2.55 | 5.9 | 5.16 |
| 81 | est | 29.13 | 11.12 | 5.34 | 10.36 | 5.43 | 15.41 |
| 82 | est | 0.17 | 0.42 | 0.44 | 0.28 | 0.55 | 0.43 |
| 83 | GLDC | 0.38 | 0.58 | 0.74 | 0.45 | 0.44 | 0.32 |
| 84 | ADRB2 | 2.93 | 2.21 | 0.98 | 1.54 | 2.51 | 0.86 |
| 85 | ICSBP1 | 0.3 | 0.42 | 0.71 | 0.26 | 0.16 | 0.29 |
| 86 | CD48 | 0.66 | 0.28 | 0.27 | 0.47 | 0.3 | 0.97 |
| 87 | est | 2.07 | 1.93 | 0.41 | 3.15 | 0.96 | 0.67 |
| 88 | DYRK1B | 0.52 | 0.53 | 0.58 | 0.63 | 0.75 | 0.61 |
| 89 | KLRC1 | 0.08 | 0.27 | 0.11 | 0.16 | 0.13 | 0.08 |
| 90 | est | 0.21 | 0.11 | 0.16 | 0.13 | 0.14 | 0.21 |
| 91 | est | 1.47 | 1.03 | 0.78 | 1.24 | 2.07 | 0.72 |
| 92 | est | 0.07 | 0.16 | 0.1 | 0.05 | 0.12 | 0.38 |
| 93 | MOXD1 | 0.64 | 0.13 | 1.35 | 0.25 | 0.35 | 0.31 |
| 94 | est | 0.38 | 0.78 | 0.21 | 0.45 | 0.81 | 0.25 |
| 95 | est | 4.4 | 8.55 | 3.2 | 5.03 | 5.03 | 3.24 |
| 96 | GAS1 | 0.1 | 0.04 | 0.05 | 0.07 | 0.07 | 0.17 |
| 97 | COL9A2 | 2.45 | 6.53 | 0.29 | 0.95 | 0.29 | 1.67 |
| 98 | est | 1.31 | 3.59 | 1.51 | 1.39 | 1.22 | 1.32 |
| 99 | DRPLA | 0.42 | 0.2 | 0.38 | 0.34 | 0.3 | 0.3 |
| 100 | est | 21.13 | 44.17 | 8.42 | 17.06 | 9.84 | 17.03 |
| 101 | REPRIMO | 41.46 | 9.06 | 1.88 | 16.9 | 1.68 | 19.81 |
| 102 | CACNA2D2 | 0.79 | 1.48 | 0.7 | 0.81 | 1 | 0.67 |
| 103 | NEBL | 0.6 | 1.51 | 2.17 | 0.92 | 0.98 | 0.83 |
| 104 | est | 1.37 | 3.44 | 0.43 | 1.64 | 0.98 | 0.67 |
| 105 | HLA-DQA1 | 1.93 | 0.94 | 1.8 | 1.37 | 1.57 | 7.01 |
| 106 | EDG3 | 4.38 | 2.91 | 4.19 | 2.92 | 0.55 | 2.95 |
| 107 | CPVL | 1.09 | 0.26 | 0.25 | 0.77 | 0.63 | 0.99 |
| 108 | FLJ32884 | 34.54 | 12.02 | 11.43 | 22.78 | 4.38 | 8.69 |
| 109 | LCP1 | 0.85 | 0.31 | 1.04 | 0.55 | 0.55 | 0.99 |
| 110 | est | 1.01 | 3.38 | 0.39 | 1.06 | 1.4 | 4.05 |
| 111 | est | 60.29 | 100 | 21.64 | 30 | 49.33 | 51.27 |
| 112 | est | 15.13 | 7.18 | 0.42 | 10.16 | 1.91 | 13.57 |
| 113 | est | 5.06 | 6.26 | 2.06 | 4.85 | 3.83 | 1.23 |
| 114 | DKFZP564C152 | 1.12 | 1.2 | 3.65 | 1.11 | 1.47 | 1.36 |
| 115 | DMN | 1.58 | 1.79 | 8.01 | 1.1 | 1.24 | 1.88 |
| 116 | GABRA5 | 0.1 | 0.17 | 0.3 | 0.24 | 0.29 | 0.11 |
| 117 | AKR1C3 | 0.32 | 0.14 | 0.37 | 0.3 | 0.17 | 0.36 |
| 118 | LOC168850 | 2.19 | 4.27 | 2.16 | 5.59 | 5.9 | 3.3 |
| 119 | est | 3.17 | 5.68 | 9.56 | 2.94 | 8.11 | 6.23 |
| 120 | KCNQ2 | 1.31 | 0.96 | 0.8 | 1.26 | 0.68 | 1.14 |
| 121 | NME5 | 11.96 | 6.8 | 9.7 | 4.39 | 4.64 | 2.61 |
| 122 | est | 6.4 | 3.28 | 1.88 | 9.26 | 3.27 | 2.75 |
| 123 | PBX1 | 2.79 | 4.55 | 0.88 | 2.13 | 4.89 | 1.85 |
| 124 | CNTNAP2 | 2.36 | 1.71 | 3.3 | 2.57 | 2.17 | 3.77 |
| 125 | est | 67.22 | 73.47 | 27.7 | 61.6 | 10.56 | 33.87 |
| 126 | SPON1 | 4.15 | 0.91 | 3.34 | 1.9 | 2.22 | 13.38 |
| 127 | CDH8 | 0.63 | 2.8 | 0.31 | 1.02 | 1.21 | 4.7 |
| 128 | PRKCB1 | 0.92 | 1.17 | 0.31 | 1.24 | 1.6 | 0.87 |
| 129 | SLC21A11 | 7.03 | 1.79 | 1.1 | 4.85 | 2.56 | 2.78 |
| 130 | MAP4 | 28.51 | 13.84 | 30.27 | 18.09 | 9.53 | 35.79 |
| 131 | est | 3.53 | 10.47 | 1.89 | 4.57 | 2.17 | 1.63 |
| 132 | SCN7A | 5.04 | 3.82 | 35.6 | 7.58 | 8.3 | 3.22 |
| 133 | est | 0.85 | 8.02 | 3.33 | 0.99 | 9.4 | 3.65 |
| 134 | est | 5.95 | 3.36 | 1.04 | 3.02 | 1.87 | 2.31 |
| 135 | est | 1.48 | 0.82 | 1.42 | 1.43 | 1.53 | 1.75 |
| 136 | est | 0.31 | 0.47 | 0.47 | 0.44 | 0.61 | 0.57 |
| 137 | CDW52 | 0.21 | 0.09 | 0.06 | 0.22 | 0.12 | 0.14 |
| 138 | ABCB1 | 2.17 | 1.94 | 8.86 | 1.93 | 3.3 | 2.79 |
| 139 | est | 0.36 | 0.58 | 0.34 | 0.83 | 2.05 | 0.22 |
| 140 | OSF-2 | 42.12 | 2.74 | 2.09 | 9.76 | 26.42 | 70.66 |
| 141 | NRXN1 | 0.54 | 1.34 | 0.5 | 0.56 | 1.83 | 3.06 |
| 142 | ADAM22 | 1.39 | 1.58 | 1.95 | 2.21 | 1.83 | 2.01 |
| 143 | est | 3.75 | 7.17 | 9.79 | 4.01 | 2.66 | 5.63 |
| 144 | TRGV9 | 0.93 | 0.54 | 0.75 | 1.03 | 0.65 | 0.43 |
| 145 | est | 0.06 | 0.04 | 0.08 | 0.08 | 0.12 | 0.08 |
| 146 | PTPRD | 6.81 | 22.96 | 1.63 | 7.82 | 8.04 | 4.9 |
| 147 | est | 0.81 | 0.83 | 0.69 | 0.55 | 0.79 | 0.95 |
| 148 | HS3ST2 | 10.12 | 2.66 | 13.19 | 1.03 | 3.81 | 1.75 |

TABLE 9A-continued

Training Samples: Good outcome patients. (1st bar FIG. 7A)

| | | | | | | | |
|---|---|---|---|---|---|---|---|
| 149 | FGF13 | 3.12 | 3.29 | 0.76 | 3.63 | 8.41 | 2.52 |
| 150 | MKI67 | 0.57 | 0.84 | 0.14 | 0.5 | 0.43 | 0.43 |
| 151 | KIF12 | 4.04 | 8.31 | 1.58 | 3.22 | 1.3 | 1.03 |
| 152 | est | 0.85 | 3.12 | 1.21 | 0.91 | 1.21 | 1.02 |
| 153 | est | 1.27 | 0.25 | 0.48 | 1.1 | 0.47 | 1.08 |
| 154 | est | 8.14 | 3.31 | 4.97 | 6.95 | 3.44 | 9.32 |
| 155 | est | 0.36 | 0.21 | 0.17 | 0.31 | 0.35 | 0.4 |
| 156 | est | 0.58 | 7.72 | 2.19 | 0.54 | 1.49 | 2.53 |
| 157 | KLIP1 | 0.21 | 0.58 | 0.1 | 0.29 | 0.46 | 0.22 |
| 158 | est | 0.53 | 0.56 | 0.42 | 0.54 | 0.81 | 0.4 |
| 159 | LOC157570 | 0.18 | 0.3 | 0.05 | 0.27 | 0.32 | 0.26 |
| 160 | MAD2L1 | 0.22 | 0.22 | 0.05 | 0.18 | 0.34 | 0.11 |
| 161 | est | 0.51 | 2.12 | 2.92 | 0.46 | 0.32 | 2.78 |
| 162 | est | 7.12 | 6.13 | 3.17 | 6.77 | 3.41 | 3.85 |
| 163 | RGS5 | 27.94 | 44.29 | 35.88 | 78.35 | 79.41 | 27.9 |
| 164 | ATP2B4 | 2.35 | 4.53 | 5.12 | 2.81 | 6.41 | 4.75 |
| 165 | HMGCL | 0.07 | 0.03 | 0.08 | 0.06 | 0.05 | 0.24 |
| 166 | ODZ3 | 5.51 | 6.84 | 11.04 | 5.5 | 3.11 | 3.25 |
| 167 | CHGA | 100 | 100 | 43.1 | 54.1 | 81.08 | 95.38 |
| 168 | MGC33510 | 0.46 | 5.52 | 0.46 | 0.18 | 6.78 | 0.24 |
| 169 | GAGE5 | 0.01 | 0.02 | 0.01 | 0.01 | 0.01 | 0.01 |
| 170 | SARDH | 22.75 | 16.83 | 2.21 | 19.42 | 13.61 | 15.84 |
| 171 | est | 10.51 | 0.79 | 1.6 | 1.43 | 1.82 | 19.99 |
| 172 | DAT1 | 0.25 | 0.28 | 0.69 | 0.29 | 1 | 0.19 |
| 173 | FUCA1 | 4.11 | 2.54 | 1.78 | 3.02 | 1.64 | 7.02 |
| 174 | TM6SF2 | 1.27 | 2.15 | 0.7 | 0.89 | 0.84 | 0.87 |
| 175 | KCNK9 | 1.33 | 1.89 | 1.47 | 1.07 | 1.65 | 1.12 |
| 176 | ADCYAP1 | 0.51 | 3.75 | 14.76 | 0.53 | 12.24 | 1.61 |
| 177 | PLXNA4 | 2.69 | 1.26 | 0.96 | 1.32 | 0.9 | 2.73 |
| 178 | HLA-DMB | 2.28 | 0.95 | 2.5 | 1.28 | 1.36 | 3.06 |
| 179 | est | 0.36 | 0.8 | 2.54 | 0.5 | 0.65 | 0.4 |
| 180 | est | 0.27 | 0.08 | 0.39 | 0.17 | 0.26 | 0.82 |
| 181 | GRIN3A | 0.57 | 0.64 | 1.03 | 0.4 | 0.37 | 0.83 |
| 182 | OSBPL3 | 2.84 | 2.89 | 1.93 | 3.03 | 4.05 | 2.35 |
| 183 | ODZ4 | 1.97 | 8.23 | 3.96 | 1.34 | 1.64 | 2.79 |
| 184 | est | 5.8 | 3.08 | 25.12 | 8.26 | 7.78 | 2.9 |
| 185 | E2F1 | 0.57 | 0.67 | 0.09 | 0.48 | 0.39 | 0.29 |
| 186 | MGC16664 | 25.5 | 12.8 | 7.88 | 9.05 | 4.33 | 20.18 |
| 187 | HMP19 | 80.34 | 100 | 53.99 | 44.72 | 97.74 | 78.76 |
| 188 | IL2RB | 1.73 | 0.93 | 3.07 | 0.78 | 1.02 | 2.67 |
| 189 | TOPK | 0.12 | 0.26 | 0.03 | 0.14 | 0.19 | 0.15 |
| 190 | ALDH1A1 | 5.9 | 1.67 | 32.18 | 4.35 | 3.92 | 4.14 |
| 191 | CED-6 | 0.14 | 0.11 | 3.25 | 0.27 | 0.55 | 0.31 |
| 192 | est | 0.4 | 1.53 | 0.49 | 0.55 | 1.09 | 0.78 |
| 193 | A2BP1 | 9.59 | 5.4 | 2.47 | 8.24 | 3.39 | 7.09 |
| 194 | LY6E | 0.27 | 0.41 | 0.43 | 0.19 | 0.21 | 0.36 |
| 195 | est | 2.36 | 3.71 | 1.91 | 1.65 | 2.2 | 2.31 |
| 196 | est | 0.48 | 0.32 | 8.79 | 0.45 | 0.64 | 1.55 |
| 197 | PLXNC1 | 15.57 | 11.42 | 4.33 | 18.46 | 9.23 | 12.21 |
| 198 | EFS | 0.77 | 0.17 | 3.38 | 0.51 | 0.37 | 0.7 |
| 199 | ACTN2 | 5.15 | 4.47 | 0.56 | 3.12 | 4.57 | 5.24 |
| 200 | MYC | 0.08 | 0.03 | 0.08 | 0.06 | 0.07 | 0.25 |
| 201 | KIAA0527 | 0.11 | 0.16 | 0.47 | 0.21 | 0.41 | 0.26 |
| 202 | C6orf31 | 0.53 | 5.79 | 0.63 | 0.31 | 8.54 | 0.3 |
| 203 | DLL3 | 1.29 | 2.98 | 0.44 | 0.82 | 1.23 | 1.08 |
| 204 | est | 1.21 | 0.99 | 0.48 | 1.12 | 0.77 | 1.05 |
| 205 | STK33 | 0.32 | 0.82 | 1.14 | 0.37 | 0.78 | 0.32 |
| 206 | SEMA3A | 0.27 | 3.02 | 0.22 | 0.55 | 0.4 | 1.06 |
| 207 | est | 2.05 | 33.41 | 2.64 | 1.37 | 1.71 | 2.53 |
| 208 | IGSF4 | 18.11 | 42.66 | 9.33 | 8.66 | 5.65 | 9.73 |
| 209 | CKS2 | 0.11 | 0.12 | 0.05 | 0.07 | 0.09 | 0.11 |
| 210 | est | 2.74 | 2.84 | 1.1 | 1.93 | 0.76 | 2.23 |
| 211 | est | 0.45 | 0.47 | 0.23 | 0.75 | 0.86 | 0.26 |
| 212 | SIX3 | 1.56 | 95.71 | 3.74 | 1.18 | 17.6 | 12.69 |
| 213 | FLJ22002 | 0.17 | 0.08 | 0.42 | 0.19 | 0.22 | 0.14 |
| 214 | HSD17B12 | 0.42 | 0.41 | 1.93 | 0.49 | 1.27 | 1.18 |
| 215 | HBA2 | 0.81 | 0.15 | 0.09 | 0.33 | 0.33 | 0.8 |
| 216 | CDH11 | 1.45 | 0.79 | 1.37 | 1.78 | 1.77 | 2.22 |
| 217 | RGS9 | 3.81 | 4.48 | 3.04 | 1.9 | 1.83 | 4.06 |
| 218 | est | 1.29 | 3.03 | 1.99 | 0.84 | 1.68 | 0.89 |
| 219 | NCAM2 | 0.98 | 4.61 | 3.27 | 1.4 | 0.67 | 1.05 |
| 220 | BIRC5 | 0.12 | 0.3 | 0.02 | 0.14 | 0.14 | 0.12 |
| 221 | est | 3.27 | 3.29 | 0.55 | 3.07 | 1.02 | 1.26 |
| 222 | GNG12 | 0.47 | 0.56 | 1.82 | 0.43 | 0.6 | 0.83 |
| 223 | GPIG4 | 0.98 | 0.59 | 1.54 | 1.44 | 0.8 | 1.09 |
| 224 | est | 1.02 | 3.21 | 14.46 | 1.53 | 2.12 | 1.86 |
| 225 | ENPP4 | 0.93 | 0.4 | 6.89 | 1.39 | 3.95 | 3.35 |
| 226 | FMNL | 1.02 | 0.96 | 0.86 | 0.98 | 1.6 | 0.75 |

TABLE 9A-continued

Training Samples: Good outcome patients. (1st bar FIG. 7A)

| | | | | | | | |
|---|---|---|---|---|---|---|---|
| 227 | est | 0.27 | 0.07 | 0.52 | 0.2 | 0.17 | 0.27 |
| 228 | PIWIL2 | 0.58 | 4.44 | 1.03 | 0.45 | 0.56 | 8.55 |
| 229 | CLSTN1 | 1.06 | 0.61 | 1.04 | 1.01 | 1.1 | 1.04 |
| 230 | UHRF1 | 0.08 | 0.19 | 0.06 | 0.14 | 0.18 | 0.09 |
| 231 | est | 0.14 | 0.24 | 1.12 | 0.21 | 0.3 | 0.25 |
| 232 | SLC40A1 | 2.84 | 2.87 | 1.77 | 4.71 | 5.66 | 5.46 |
| 233 | CLECSF6 | 4.2 | 2.7 | 3.42 | 2.31 | 3.28 | 8.85 |
| 234 | est | 3.58 | 2.97 | 1.67 | 2.42 | 1.76 | 1.8 |
| 235 | BKLHD2 | 2.31 | 1.92 | 3.09 | 2.91 | 2.78 | 2.15 |
| 236 | est | 2.08 | 0.32 | 1.05 | 2.65 | 2.93 | 1.57 |
| 237 | est | 0.8 | 10.19 | 0.21 | 0.33 | 19.86 | 0.38 |
| 238 | est | 1.15 | 1.67 | 0.86 | 1.58 | 1.63 | 0.55 |
| 239 | SORCS1 | 30.21 | 23.81 | 57.82 | 18.64 | 8.3 | 16.75 |
| 240 | NRP2 | 17.83 | 29.44 | 15.63 | 9.06 | 7.63 | 26.01 |
| 241 | E2-EPF | 0.4 | 0.81 | 0.11 | 0.2 | 0.35 | 0.41 |
| 242 | CAST | 2.71 | 0.8 | 4.46 | 1.57 | 1.16 | 4.64 |
| 243 | KIAA1384 | 0.66 | 6.3 | 1.31 | 0.76 | 1.14 | 3.56 |
| 244 | KIAA0644 | 1.82 | 0.8 | 0.33 | 1.74 | 0.72 | 1.42 |
| 245 | HLA-DRB3 | 3.55 | 1.34 | 9.56 | 2.33 | 2.4 | 6.46 |
| 246 | PMP22 | 8.35 | 4.38 | 21.1 | 8.1 | 5.46 | 7.65 |
| 247 | DJ79P11.1 | 9.82 | 7.65 | 7.54 | 5.99 | 12.53 | 8.9 |
| 248 | SOX5 | 1.32 | 7.15 | 2.7 | 1.67 | 1.46 | 1.61 |
| 249 | CD3E | 10.59 | 11.33 | 3.77 | 4.54 | 4.08 | 6.59 |
| 250 | est | 0.81 | 3.54 | 0.46 | 1.49 | 1.17 | 4.9 |

| Rank | St2_NA_NB15 | St2_NA_NB231 | St2_NA_NB255 | St3_NA_NB216 | St3_NA_NB61 | St4_A_NB14 |
|---|---|---|---|---|---|---|
| 1 | 0.01 | 0.05 | 2.8 | 0.16 | 0.17 | 0.77 |
| 2 | 0.4 | 0.32 | 0.49 | 0.26 | 0.89 | 0.7 |
| 3 | 1.48 | 0.85 | 4.01 | 4.14 | 8.16 | 7.72 |
| 4 | 3.62 | 1.69 | 0.54 | 0.73 | 0.63 | 4.32 |
| 5 | 1.24 | 1.87 | 5.79 | 6.99 | 1.96 | 1.57 |
| 6 | 19.17 | 21.25 | 35.38 | 14.94 | 57.24 | 15.41 |
| 7 | 7.16 | 11.72 | 3.76 | 24.05 | 2.72 | 8.43 |
| 8 | 0.39 | 0.14 | 0.58 | 0.19 | 0.23 | 1.34 |
| 9 | 1.35 | 0.5 | 0.3 | 0.63 | 1.06 | 0.39 |
| 10 | 0.6 | 0.44 | 1.3 | 1.26 | 0.41 | 0.95 |
| 11 | 0.24 | 0.28 | 2.47 | 0.37 | 0.44 | 0.99 |
| 12 | 4.89 | 2.83 | 2.9 | 2.23 | 2.87 | 2.06 |
| 13 | 0.99 | 3.79 | 1.6 | 2.44 | 0.16 | 0.84 |
| 14 | 4.12 | 8.28 | 9.32 | 6.99 | 0.76 | 2.98 |
| 15 | 0.87 | 0.59 | 0.38 | 1.36 | 0.83 | 0.7 |
| 16 | 2.53 | 4.38 | 3.54 | 5.27 | 6.12 | 15.84 |
| 17 | 20.86 | 8.17 | 3.19 | 6.67 | 4.41 | 2.21 |
| 18 | 0.08 | 0.08 | 0.07 | 0.07 | 0.06 | 0.12 |
| 19 | 0.07 | 0.16 | 0.06 | 0.1 | 0.09 | 0.28 |
| 20 | 10.33 | 23.73 | 19.55 | 28.44 | 3.4 | 5.16 |
| 21 | 2.02 | 0.82 | 1.76 | 10.83 | 1.1 | 26.9 |
| 22 | 0.08 | 0.06 | 0.07 | 0.1 | 0.09 | 0.34 |
| 23 | 1.59 | 0.31 | 0.7 | 1.11 | 0.99 | 0.4 |
| 24 | 2.09 | 1.56 | 3.78 | 0.94 | 5.05 | 0.8 |
| 25 | 16.89 | 14.31 | 8.41 | 12.76 | 2.6 | 11.62 |
| 26 | 20.3 | 23.02 | 17.51 | 10.04 | 15.86 | 21.3 |
| 27 | 0.33 | 0.15 | 0.06 | 0.12 | 0.15 | 0.26 |
| 28 | 13.3 | 18.96 | 4.12 | 13.37 | 3.45 | 7.87 |
| 29 | 0.18 | 0.07 | 0.06 | 0.15 | 0.07 | 0.24 |
| 30 | 0.69 | 0.3 | 0.27 | 0.44 | 0.49 | 0.42 |
| 31 | 0.11 | 8.78 | 16.68 | 0.08 | 0.2 | 0.04 |
| 32 | 14.88 | 22.56 | 29.09 | 18.99 | 16.8 | 5.25 |
| 33 | 1.31 | 1.14 | 2.23 | 0.53 | 1.15 | 2.62 |
| 34 | 0.55 | 0.89 | 0.29 | 0.36 | 0.19 | 0.13 |
| 35 | 2.8 | 2.07 | 3.28 | 1.84 | 2.51 | 1.32 |
| 36 | 7.67 | 8.31 | 2.46 | 8.87 | 2.62 | 10.72 |
| 37 | 0.95 | 0.43 | 1.8 | 1.73 | 0.37 | 0.84 |
| 38 | 0.62 | 1.44 | 1.49 | 0.84 | 0.05 | 1.46 |
| 39 | 1.17 | 0.47 | 0.44 | 0.28 | 0.59 | 6.14 |
| 40 | 3.45 | 4.63 | 6.81 | 2.08 | 6.46 | 4.04 |
| 41 | 1.71 | 1.44 | 5.35 | 2.94 | 6.1 | 2.95 |
| 42 | 2.2 | 18.62 | 11.65 | 40.36 | 1.1 | 52.13 |
| 43 | 0.28 | 0.34 | 0.38 | 0.22 | 3.19 | 3.74 |
| 44 | 0.73 | 0.65 | 0.66 | 2.69 | 1.97 | 1.27 |
| 45 | 0.85 | 2.44 | 0.57 | 1.42 | 0.54 | 0.82 |
| 46 | 3.67 | 6.06 | 1.19 | 3.22 | 1.46 | 1.42 |
| 47 | 0.58 | 0.35 | 0.3 | 0.5 | 0.41 | 0.45 |
| 48 | 0.54 | 0.22 | 0.53 | 0.09 | 1.09 | 0.63 |
| 49 | 0.26 | 0.82 | 0.1 | 1.14 | 0.07 | 1.36 |
| 50 | 0.09 | 0.56 | 0.39 | 0.24 | 0.23 | 0.5 |
| 51 | 0.44 | 0.3 | 0.49 | 0.41 | 0.42 | 0.65 |

TABLE 9A-continued

Training Samples: Good outcome patients. (1st bar FIG. 7A)

| | | | | | | |
|---|---|---|---|---|---|---|
| 52 | 0.36 | 0.36 | 0.27 | 0.33 | 0.59 | 0.39 |
| 53 | 12.81 | 12.41 | 6.76 | 13.01 | 6.81 | 1.29 |
| 54 | 0.96 | 3.49 | 3.91 | 8.35 | 0.71 | 9.8 |
| 55 | 1.14 | 0.91 | 0.99 | 1.21 | 0.85 | 2.53 |
| 56 | 0.73 | 0.66 | 0.62 | 3 | 2.4 | 0.98 |
| 57 | 5.28 | 5.48 | 3.86 | 0.26 | 4.35 | 3.55 |
| 58 | 12.19 | 25 | 12.15 | 12.54 | 10.4 | 1.81 |
| 59 | 4.39 | 3.38 | 1.54 | 3.19 | 1.47 | 1.27 |
| 60 | 12.4 | 9.38 | 20.91 | 15.14 | 18.19 | 32.84 |
| 61 | 11.29 | 10 | 19.75 | 16.99 | 21.54 | 37.68 |
| 62 | 0.46 | 0.56 | 1.76 | 2.06 | 0.52 | 4.12 |
| 63 | 6.35 | 11.21 | 5.61 | 10.69 | 3.01 | 2.05 |
| 64 | 2.48 | 13.11 | 1.69 | 11.24 | 2.95 | 7.27 |
| 65 | 11.91 | 13.14 | 19.48 | 11.43 | 2.01 | 3.23 |
| 66 | 0.45 | 1.03 | 0.78 | 0.31 | 0.66 | 0.44 |
| 67 | 0.77 | 0.49 | 0.5 | 0.52 | 0.56 | 1.01 |
| 68 | 1.3 | 3.07 | 0.74 | 2.23 | 1.38 | 1.64 |
| 69 | 2.17 | 4.06 | 85.14 | 7.03 | 1.56 | 18.58 |
| 70 | 0.02 | 0.05 | 0.03 | 0.05 | 0.03 | 0.1 |
| 71 | 4.08 | 2.17 | 1.68 | 5.08 | 1.17 | 2.62 |
| 72 | 25.89 | 49.14 | 43.89 | 45.02 | 5.94 | 8.6 |
| 73 | 4.4 | 16.39 | 45.39 | 27.56 | 48.63 | 9.75 |
| 74 | 1.18 | 1.7 | 1.08 | 1.21 | 0.72 | 0.58 |
| 75 | 2.17 | 2.07 | 3.28 | 3.42 | 0.87 | 1.57 |
| 76 | 5.38 | 11.26 | 4.72 | 10.08 | 3.06 | 2.18 |
| 77 | 7.52 | 9.26 | 11.3 | 11.64 | 3.29 | 2.09 |
| 78 | 2.73 | 3.33 | 3.99 | 2.24 | 2.53 | 1.55 |
| 79 | 10.02 | 15.81 | 6.93 | 7.52 | 0.81 | 2.27 |
| 80 | 12.39 | 4.67 | 1.88 | 9.85 | 0.97 | 8.46 |
| 81 | 14.12 | 15.74 | 17.31 | 21.13 | 25.08 | 10.33 |
| 82 | 0.21 | 0.32 | 0.36 | 0.29 | 0.25 | 0.44 |
| 83 | 0.37 | 0.57 | 0.56 | 0.63 | 0.33 | 1.51 |
| 84 | 2.26 | 1.65 | 1.18 | 1.14 | 1.84 | 0.92 |
| 85 | 0.66 | 1.22 | 1.32 | 0.87 | 0.22 | 1.06 |
| 86 | 0.99 | 0.84 | 0.56 | 0.37 | 1.66 | 1.53 |
| 87 | 1.24 | 3.9 | 1.05 | 1.86 | 0.34 | 0.71 |
| 88 | 0.46 | 0.47 | 0.5 | 0.47 | 0.88 | 0.64 |
| 89 | 0.13 | 0.22 | 0.1 | 0.15 | 0.12 | 0.3 |
| 90 | 0.17 | 0.16 | 0.25 | 0.12 | 0.26 | 0.33 |
| 91 | 1.33 | 1.27 | 2.9 | 1.43 | 2.41 | 2.93 |
| 92 | 0.05 | 0.53 | 0.24 | 0.47 | 0.05 | 1.38 |
| 93 | 1.06 | 0.2 | 0.2 | 0.13 | 0.33 | 0.84 |
| 94 | 0.26 | 0.32 | 1.2 | 0.37 | 0.71 | 0.25 |
| 95 | 11.31 | 11.15 | 7.77 | 10.7 | 1.88 | 2.03 |
| 96 | 0.1 | 0.2 | 0.05 | 0.05 | 0.31 | 0.08 |
| 97 | 2.4 | 1.12 | 0.33 | 0.48 | 0.54 | 0.37 |
| 98 | 1.83 | 2.95 | 0.54 | 3.74 | 0.35 | 1.42 |
| 99 | 0.49 | 0.25 | 0.23 | 0.41 | 0.31 | 0.28 |
| 100 | 15.43 | 41.94 | 22.27 | 94.04 | 8.57 | 11.28 |
| 101 | 18.53 | 36.26 | 8.22 | 12.15 | 2.78 | 1.19 |
| 102 | 0.76 | 0.7 | 0.67 | 2.28 | 2.1 | 0.9 |
| 103 | 1.2 | 1.21 | 0.45 | 2.65 | 0.22 | 1.37 |
| 104 | 2.22 | 1.86 | 1.13 | 1.91 | 0.43 | 0.98 |
| 105 | 3.71 | 2.07 | 1.34 | 1.07 | 7.8 | 9.09 |
| 106 | 3.11 | 3.25 | 2.61 | 3.64 | 3.28 | 3.87 |
| 107 | 0.58 | 0.4 | 0.96 | 0.3 | 1.95 | 2.9 |
| 108 | 7.03 | 17.66 | 5.79 | 47.13 | 2.65 | 9.76 |
| 109 | 0.69 | 0.99 | 0.96 | 0.47 | 1.52 | 1.71 |
| 110 | 1.17 | 0.75 | 1.25 | 3.96 | 0.92 | 1.43 |
| 111 | 52.21 | 58.31 | 74.77 | 51.74 | 33.22 | 52.1 |
| 112 | 9.32 | 10.16 | 5.54 | 15.21 | 9.42 | 1.64 |
| 113 | 1.85 | 4.64 | 9.18 | 11.07 | 1.89 | 8.2 |
| 114 | 1.32 | 1.41 | 2.01 | 0.68 | 0.91 | 3.07 |
| 115 | 1.87 | 1.48 | 2.3 | 2.48 | 1 | 2.22 |
| 116 | 0.14 | 0.21 | 0.15 | 0.35 | 0.14 | 0.34 |
| 117 | 0.39 | 0.22 | 0.18 | 0.3 | 0.31 | 0.3 |
| 118 | 7.68 | 6.92 | 4.01 | 5.33 | 2.47 | 1.06 |
| 119 | 4.31 | 4.92 | 4.16 | 4.77 | 3.45 | 7.02 |
| 120 | 1.16 | 0.61 | 0.69 | 0.75 | 1.05 | 1.12 |
| 121 | 6.2 | 1.62 | 2.69 | 2.41 | 2.94 | 2.2 |
| 122 | 2.18 | 4.59 | 1.28 | 2.33 | 0.84 | 4.54 |
| 123 | 1.96 | 1.97 | 1.73 | 2.05 | 1.34 | 1.36 |
| 124 | 2.49 | 1.37 | 2.1 | 0.92 | 2.32 | 1.27 |
| 125 | 26.55 | 2.09 | 9.07 | 5.17 | 11.05 | 16.58 |
| 126 | 6.21 | 3.75 | 3.99 | 1.02 | 9.76 | 4.35 |
| 127 | 1.15 | 0.64 | 0.73 | 3.32 | 0.56 | 1.79 |
| 128 | 0.68 | 0.92 | 0.59 | 1.54 | 1.29 | 0.75 |
| 129 | 2.45 | 4.83 | 1.77 | 4.73 | 3.03 | 1.2 |

TABLE 9A-continued

Training Samples: Good outcome patients. (1st bar FIG. 7A)

| | | | | | | |
|---|---|---|---|---|---|---|
| 130 | 14.34 | 20.16 | 19.78 | 10.76 | 16.6 | 25.48 |
| 131 | 3.71 | 5.26 | 7.23 | 11.09 | 1.65 | 2.62 |
| 132 | 14.67 | 10.54 | 9.64 | 12.24 | 3.5 | 6.74 |
| 133 | 2.8 | 2.6 | 1.28 | 2.79 | 0.93 | 1.09 |
| 134 | 2.78 | 2.16 | 2.37 | 4.08 | 1.08 | 1.43 |
| 135 | 1.21 | 0.56 | 0.54 | 0.56 | 0.63 | 0.5 |
| 136 | 0.32 | 0.36 | 0.5 | 0.68 | 0.39 | 0.73 |
| 137 | 0.53 | 0.41 | 0.41 | 0.21 | 0.51 | 1.02 |
| 138 | 4.02 | 3.01 | 11.14 | 5.72 | 12.09 | 3.23 |
| 139 | 1.69 | 1.58 | 0.35 | 0.4 | 0.28 | 0.32 |
| 140 | 9.22 | 2.97 | 31.96 | 6.03 | 34.87 | 19.54 |
| 141 | 0.62 | 0.63 | 1.9 | 2.13 | 0.61 | 2.83 |
| 142 | 1.75 | 2.63 | 2.52 | 4.34 | 1.66 | 3.52 |
| 143 | 6.28 | 8.33 | 9.68 | 14.54 | 2.66 | 23.94 |
| 144 | 1.52 | 2.13 | 1.34 | 0.98 | 1.79 | 0.8 |
| 145 | 0.19 | 0.07 | 0.85 | 0.06 | 0.54 | 0.34 |
| 146 | 4.97 | 7.46 | 5.08 | 17.08 | 1.02 | 17.63 |
| 147 | 0.76 | 0.65 | 0.66 | 0.7 | 0.77 | 0.72 |
| 148 | 2.12 | 3.13 | 4.39 | 2.59 | 2.18 | 17.47 |
| 149 | 2.19 | 3.82 | 3.4 | 4.3 | 1.02 | 5.47 |
| 150 | 0.37 | 0.36 | 1.24 | 0.55 | 0.72 | 0.2 |
| 151 | 0.84 | 1.6 | 14.3 | 7.83 | 1.24 | 8.39 |
| 152 | 0.98 | 1.1 | 1.22 | 0.99 | 1.02 | 0.91 |
| 153 | 2.58 | 3.04 | 0.67 | 0.89 | 3.64 | 0.76 |
| 154 | 17.28 | 31.39 | 4.64 | 6.05 | 32.3 | 2.37 |
| 155 | 0.59 | 0.23 | 2.58 | 0.24 | 1.1 | 1.02 |
| 156 | 5.79 | 2.88 | 6.47 | 6.73 | 1.34 | 2.65 |
| 157 | 0.22 | 0.32 | 1.05 | 0.33 | 0.41 | 0.14 |
| 158 | 0.5 | 0.65 | 0.65 | 0.6 | 0.8 | 0.61 |
| 159 | 0.2 | 0.2 | 0.61 | 0.2 | 0.46 | 0.16 |
| 160 | 0.14 | 0.34 | 0.46 | 0.09 | 0.22 | 0.09 |
| 161 | 1.29 | 2.07 | 0.39 | 0.72 | 1.16 | 2.4 |
| 162 | 9.64 | 9.12 | 5.63 | 9.63 | 2.88 | 4.33 |
| 163 | 52.39 | 50.96 | 49.94 | 44.69 | 35.38 | 22.35 |
| 164 | 3.61 | 3.53 | 1.99 | 4.39 | 2.6 | 3.04 |
| 165 | 0.26 | 0.12 | 0.51 | 0.1 | 0.09 | 0.09 |
| 166 | 3.8 | 2.91 | 2.65 | 5.28 | 1.26 | 3.14 |
| 167 | 100 | 64.75 | 100 | 73.13 | 64.13 | 88.95 |
| 168 | 0.16 | 6.79 | 19.63 | 0.15 | 0.22 | 0.12 |
| 169 | 0.01 | 0.01 | 0.01 | 0.01 | 0.02 | 0.02 |
| 170 | 15.11 | 21.51 | 16.4 | 12.31 | 8.36 | 4.44 |
| 171 | 6.89 | 22.1 | 4.22 | 1.8 | 21.4 | 8.58 |
| 172 | 0.75 | 0.22 | 0.34 | 0.33 | 0.38 | 1.93 |
| 173 | 2.46 | 2.53 | 5.36 | 1.86 | 8.43 | 9.91 |
| 174 | 2.36 | 1.96 | 1.23 | 1.19 | 1.05 | 1.28 |
| 175 | 0.79 | 0.9 | 2.15 | 1.37 | 1.47 | 4.47 |
| 176 | 2.31 | 2.11 | 0.83 | 1.12 | 3.09 | 4.17 |
| 177 | 2.22 | 3.12 | 1.77 | 1.39 | 2.38 | 0.99 |
| 178 | 2.79 | 1.63 | 2.89 | 1.09 | 3.69 | 9.77 |
| 179 | 1.84 | 1.61 | 0.79 | 1.59 | 0.41 | 1.19 |
| 180 | 0.42 | 0.55 | 0.34 | 0.12 | 0.59 | 0.82 |
| 181 | 1.06 | 0.82 | 0.38 | 1.14 | 0.51 | 2.14 |
| 182 | 3.43 | 3.26 | 1.86 | 2.6 | 1.88 | 1.14 |
| 183 | 4.62 | 3.41 | 5.18 | 3.43 | 2.21 | 4.56 |
| 184 | 10.55 | 11.75 | 12.34 | 13.53 | 3.2 | 3.21 |
| 185 | 0.43 | 0.27 | 1.38 | 0.41 | 0.82 | 0.25 |
| 186 | 13.6 | 8.37 | 13.86 | 18.03 | 12.22 | 12.54 |
| 187 | 100 | 57.47 | 87.77 | 68.09 | 84.44 | 63.09 |
| 188 | 3.42 | 1.31 | 1.12 | 0.78 | 3.45 | 3.61 |
| 189 | 0.17 | 0.22 | 0.86 | 0.18 | 0.33 | 0.07 |
| 190 | 18.52 | 8.42 | 3.32 | 1.56 | 4.42 | 9.84 |
| 191 | 1.65 | 0.59 | 0.36 | 0.31 | 0.35 | 0.34 |
| 192 | 0.7 | 0.56 | 1.47 | 1.22 | 0.43 | 1.1 |
| 193 | 1.9 | 2.7 | 1.11 | 6.08 | 1.35 | 6.53 |
| 194 | 0.29 | 0.22 | 1.13 | 0.21 | 0.44 | 0.55 |
| 195 | 5.19 | 1.81 | 1.61 | 1.57 | 1.25 | 1.3 |
| 196 | 3.26 | 1.19 | 1.16 | 0.6 | 1.14 | 0.58 |
| 197 | 6.75 | 21.34 | 4.94 | 22.2 | 10.89 | 4.76 |
| 198 | 1.29 | 0.99 | 0.43 | 0.64 | 0.55 | 0.51 |
| 199 | 0.57 | 0.49 | 0.64 | 4.22 | 0.41 | 1.26 |
| 200 | 0.25 | 0.12 | 0.46 | 0.12 | 0.08 | 0.09 |
| 201 | 0.19 | 0.22 | 0.17 | 0.08 | 0.15 | 0.92 |
| 202 | 0.32 | 4.72 | 13.45 | 0.22 | 0.34 | 0.23 |
| 203 | 0.9 | 0.85 | 4.79 | 0.91 | 0.33 | 1.58 |
| 204 | 0.67 | 1 | 0.95 | 1.02 | 0.8 | 1.6 |
| 205 | 0.77 | 0.27 | 0.56 | 0.54 | 0.5 | 1.24 |
| 206 | 0.84 | 1.34 | 0.62 | 0.54 | 0.27 | 0.38 |
| 207 | 1.63 | 0.74 | 43.66 | 10.77 | 0.7 | 10.62 |

TABLE 9A-continued

Training Samples: Good outcome patients. (1st bar FIG. 7A)

| | | | | | | |
|---|---|---|---|---|---|---|
| 208 | 19.87 | 39.92 | 12.24 | 37.08 | 8.95 | 6.05 |
| 209 | 0.08 | 0.09 | 0.25 | 0.09 | 0.14 | 0.11 |
| 210 | 2.65 | 2.63 | 0.89 | 2.03 | 1.54 | 1.15 |
| 211 | 0.56 | 0.68 | 1.41 | 0.62 | 0.54 | 0.39 |
| 212 | 3.33 | 7.01 | 37.74 | 39.78 | 6.1 | 16.72 |
| 213 | 0.35 | 0.19 | 0.08 | 0.16 | 0.16 | 0.12 |
| 214 | 0.92 | 0.59 | 1.08 | 0.35 | 0.6 | 2.36 |
| 215 | 0.16 | 0.28 | 0.86 | 0.57 | 1.24 | 0.49 |
| 216 | 1.62 | 1.17 | 0.85 | 0.66 | 1.28 | 1.22 |
| 217 | 3.58 | 1.69 | 1.94 | 4.27 | 1.64 | 1.31 |
| 218 | 2.33 | 2.94 | 2.89 | 2.8 | 0.81 | 1.47 |
| 219 | 2.16 | 2.5 | 1.04 | 4.06 | 0.28 | 3.58 |
| 220 | 0.13 | 0.1 | 0.41 | 0.11 | 0.13 | 0.07 |
| 221 | 1.6 | 3.45 | 1.26 | 1.14 | 0.65 | 1.53 |
| 222 | 0.99 | 0.73 | 0.38 | 0.37 | 0.58 | 0.57 |
| 223 | 1.51 | 1.4 | 0.84 | 1.38 | 1.07 | 2.6 |
| 224 | 1.54 | 1.92 | 24.61 | 3.89 | 2.42 | 2.24 |
| 225 | 1.45 | 2.61 | 1.35 | 0.36 | 1.42 | 2.27 |
| 226 | 1.28 | 0.97 | 2.42 | 0.96 | 1.93 | 2.71 |
| 227 | 0.43 | 0.28 | 0.18 | 0.33 | 0.25 | 0.66 |
| 228 | 0.9 | 0.68 | 0.63 | 1.91 | 0.87 | 0.48 |
| 229 | 0.89 | 0.37 | 0.3 | 0.54 | 0.94 | 0.41 |
| 230 | 0.07 | 0.09 | 0.1 | 0.11 | 0.15 | 0.1 |
| 231 | 0.69 | 0.57 | 0.27 | 0.19 | 0.14 | 0.4 |
| 232 | 6.02 | 4.13 | 3.63 | 2.31 | 9.64 | 15.63 |
| 233 | 5.15 | 3.75 | 3.93 | 2.43 | 8.6 | 6.56 |
| 234 | 1.34 | 2.83 | 2.16 | 2.28 | 2.64 | 3.56 |
| 235 | 1.6 | 3.76 | 3.14 | 4.73 | 2.2 | 3.53 |
| 236 | 1.97 | 2.64 | 0.66 | 1.66 | 0.71 | 0.96 |
| 237 | 0.2 | 18.16 | 23.66 | 0.39 | 0.43 | 0.37 |
| 238 | 1.32 | 1.57 | 1.47 | 1.3 | 0.39 | 0.51 |
| 239 | 16.05 | 13.17 | 8.14 | 28.46 | 2.22 | 12.18 |
| 240 | 35.56 | 27.44 | 20.28 | 41.75 | 10.35 | 6.04 |
| 241 | 0.23 | 0.11 | 0.62 | 0.21 | 0.31 | 0.24 |
| 242 | 3.01 | 2.2 | 1.69 | 1.02 | 5.58 | 4.26 |
| 243 | 1.27 | 1.35 | 0.8 | 8.02 | 1.08 | 3.07 |
| 244 | 0.56 | 0.73 | 0.26 | 0.48 | 1.19 | 0.46 |
| 245 | 5.84 | 3.28 | 2.47 | 1.78 | 7.92 | 6.79 |
| 246 | 9.97 | 5.88 | 7.24 | 9.41 | 9.24 | 7.49 |
| 247 | 3.5 | 4.2 | 6.51 | 6.51 | 7.98 | 13.04 |
| 248 | 1.77 | 2.29 | 0.88 | 1.89 | 1.22 | 1.16 |
| 249 | 7.15 | 6.49 | 8.39 | 4.64 | 7.22 | 9.99 |
| 250 | 1.12 | 0.76 | 0.74 | 3.92 | 0.81 | 1.31 |

| Rank | St4_NA_NB2 | St4_NA_NB3 | St4_NA_NB30 | St4_NA_NB31 | St4_NA_NB32 | St4_NA_NB4 |
|---|---|---|---|---|---|---|
| 1 | 0.04 | 0.05 | 0.03 | 0.02 | 0.13 | 0.02 |
| 2 | 0.19 | 0.26 | 0.4 | 0.44 | 0.21 | 0.22 |
| 3 | 1.43 | 1.33 | 1.1 | 1.65 | 2.51 | 1.38 |
| 4 | 3.46 | 4.24 | 4.99 | 12.14 | 4.28 | 12.94 |
| 5 | 4.33 | 5.83 | 3.53 | 1.18 | 2.15 | 2.63 |
| 6 | 15.11 | 17.85 | 11.25 | 6.89 | 19.19 | 11.35 |
| 7 | 5.69 | 9.49 | 8.67 | 10.28 | 14.78 | 10.12 |
| 8 | 0.32 | 0.25 | 0.32 | 0.33 | 0.1 | 0.24 |
| 9 | 1.41 | 1.81 | 1.31 | 1.73 | 0.41 | 2.08 |
| 10 | 3.15 | 4.19 | 3.14 | 4.45 | 3.82 | 2.88 |
| 11 | 0.11 | 0.11 | 0.15 | 0.15 | 0.27 | 0.14 |
| 12 | 3.1 | 3.22 | 3.25 | 2.42 | 3.23 | 3.54 |
| 13 | 1 | 1.1 | 1.36 | 1.75 | 2.06 | 1.01 |
| 14 | 5.16 | 6.39 | 5.17 | 9.86 | 10.31 | 9.87 |
| 15 | 1.05 | 1.54 | 1.6 | 2.38 | 2.1 | 2.7 |
| 16 | 1.84 | 2.46 | 0.86 | 3.66 | 8.55 | 5.01 |
| 17 | 9.83 | 13.43 | 15.64 | 51.6 | 18.05 | 37.79 |
| 18 | 0.04 | 0.03 | 0.04 | 0.04 | 0.09 | 0.02 |
| 19 | 0.21 | 0.24 | 0.26 | 0.29 | 0.1 | 0.13 |
| 20 | 2.64 | 2.13 | 2.09 | 5.38 | 11.13 | 5.28 |
| 21 | 3.59 | 3.83 | 4.5 | 2.72 | 9.28 | 1.67 |
| 22 | 0.06 | 0.06 | 0.07 | 0.09 | 0.06 | 0.09 |
| 23 | 1.42 | 1.12 | 1.11 | 2.52 | 2.19 | 2.6 |
| 24 | 1.56 | 1.3 | 1.21 | 1.42 | 1.42 | 1.29 |
| 25 | 11.29 | 12.52 | 6.77 | 28.77 | 15.46 | 18.8 |
| 26 | 15.81 | 19.38 | 20.99 | 10.73 | 9.65 | 9.9 |
| 27 | 0.25 | 0.25 | 0.17 | 0.42 | 0.44 | 0.54 |
| 28 | 19.42 | 31.2 | 15.83 | 48.08 | 26.76 | 71.64 |
| 29 | 0.45 | 0.54 | 0.42 | 0.41 | 0.25 | 0.57 |
| 30 | 0.17 | 0.26 | 0.19 | 0.38 | 0.61 | 0.37 |
| 31 | 13.45 | 7.6 | 11.48 | 11.64 | 0.07 | 9.18 |
| 32 | 3.74 | 5.34 | 7.06 | 2.93 | 5.05 | 1.23 |

TABLE 9A-continued

Training Samples: Good outcome patients. (1st bar FIG. 7A)

| | | | | | | |
|---|---|---|---|---|---|---|
| 33 | 1.21 | 1.36 | 1.38 | 0.53 | 1.52 | 0.52 |
| 34 | 0.31 | 0.3 | 0.31 | 0.31 | 0.2 | 0.24 |
| 35 | 1.78 | 2.45 | 1.16 | 2.21 | 2.46 | 6.92 |
| 36 | 6.68 | 6.12 | 6.09 | 4.62 | 5.7 | 6.6 |
| 37 | 1.84 | 2.25 | 1.79 | 3.76 | 3.57 | 2.64 |
| 38 | 0.17 | 0.19 | 0.13 | 0.19 | 0.23 | 0.17 |
| 39 | 0.91 | 1.03 | 1.13 | 1.15 | 0.3 | 1.08 |
| 40 | 3.2 | 2.86 | 2.51 | 2.22 | 1.83 | 2.11 |
| 41 | 2 | 2.31 | 1.66 | 1.52 | 2.4 | 2.25 |
| 42 | 2.07 | 2.5 | 2.98 | 1.05 | 1.49 | 0.89 |
| 43 | 4.86 | 4.5 | 3.87 | 0.77 | 2.64 | 0.87 |
| 44 | 0.8 | 0.74 | 0.75 | 0.58 | 0.69 | 0.53 |
| 45 | 0.67 | 0.73 | 0.84 | 1.29 | 0.95 | 0.89 |
| 46 | 0.97 | 0.99 | 0.99 | 6.27 | 1.11 | 6.76 |
| 47 | 0.2 | 0.21 | 0.23 | 0.39 | 0.63 | 0.42 |
| 48 | 1.06 | 1.25 | 0.73 | 0.2 | 0.32 | 0.57 |
| 49 | 0.19 | 0.4 | 0.26 | 0.59 | 0.35 | 0.47 |
| 50 | 0.35 | 0.16 | 0.22 | 0.17 | 0.37 | 0.16 |
| 51 | 0.51 | 0.38 | 0.56 | 0.46 | 0.48 | 0.31 |
| 52 | 0.43 | 0.34 | 0.43 | 0.37 | 0.72 | 0.34 |
| 53 | 7.59 | 6.51 | 5.39 | 12.41 | 8.29 | 8.97 |
| 54 | 1.34 | 1.39 | 1.12 | 0.69 | 0.7 | 0.67 |
| 55 | 1.43 | 1.38 | 1.06 | 1.94 | 1.64 | 1.7 |
| 56 | 1 | 0.77 | 0.77 | 0.75 | 0.86 | 0.63 |
| 57 | 4.01 | 5.24 | 5.61 | 6.75 | 6.38 | 5.65 |
| 58 | 24.88 | 20.71 | 14.56 | 37.79 | 16.64 | 34.32 |
| 59 | 1.4 | 0.98 | 1.45 | 1.79 | 3.19 | 1.94 |
| 60 | 30.43 | 27.28 | 23.7 | 7.24 | 16.17 | 19.67 |
| 61 | 31.65 | 33.38 | 24.05 | 9.15 | 14.52 | 22.83 |
| 62 | 2.33 | 3.25 | 3.06 | 5.36 | 6.51 | 3.79 |
| 63 | 4.9 | 6.74 | 6.56 | 12.35 | 8.33 | 8.88 |
| 64 | 5.84 | 2.3 | 5.04 | 11.08 | 8.57 | 7.5 |
| 65 | 14.59 | 17.84 | 16.23 | 11.37 | 11.41 | 10.83 |
| 66 | 0.62 | 0.73 | 0.64 | 0.3 | 0.26 | 0.3 |
| 67 | 1.44 | 1.91 | 0.96 | 1.11 | 0.8 | 1.42 |
| 68 | 1.59 | 2.06 | 2.35 | 2 | 1.61 | 1.9 |
| 69 | 11.42 | 5.83 | 8.59 | 1.14 | 13.47 | 2.38 |
| 70 | 0.04 | 0.03 | 0.2 | 0.06 | 0.02 | 0.02 |
| 71 | 5.04 | 5.79 | 3.3 | 5.11 | 7.68 | 4.67 |
| 72 | 30.3 | 38.86 | 26.93 | 41.3 | 53.93 | 23.56 |
| 73 | 27.19 | 25.47 | 28.24 | 8.11 | 7.12 | 13.47 |
| 74 | 0.79 | 0.83 | 1.89 | 1.41 | 1.65 | 1.48 |
| 75 | 4.05 | 3.63 | 2.41 | 3.27 | 2.36 | 4.35 |
| 76 | 4.37 | 6.75 | 6.97 | 9.17 | 7.08 | 7.34 |
| 77 | 10.38 | 10.78 | 8.5 | 18.25 | 14.07 | 19.44 |
| 78 | 2.16 | 2.83 | 2.05 | 5.97 | 6.25 | 6.59 |
| 79 | 2.38 | 2.32 | 7.64 | 5.48 | 8.37 | 5.05 |
| 80 | 5.89 | 7.42 | 9.77 | 20.77 | 5.69 | 14.47 |
| 81 | 14.9 | 13.32 | 10.53 | 12.61 | 16.61 | 14.42 |
| 82 | 0.7 | 0.89 | 0.81 | 1.14 | 0.52 | 0.77 |
| 83 | 0.43 | 0.46 | 0.71 | 0.43 | 0.29 | 0.32 |
| 84 | 0.74 | 0.71 | 0.7 | 1.16 | 0.79 | 1.96 |
| 85 | 0.23 | 0.22 | 0.24 | 0.22 | 0.28 | 0.23 |
| 86 | 0.58 | 0.47 | 0.75 | 0.71 | 0.68 | 0.61 |
| 87 | 1.14 | 1.3 | 1.11 | 1.44 | 1.12 | 0.98 |
| 88 | 0.52 | 0.56 | 0.61 | 0.57 | 0.53 | 0.5 |
| 89 | 0.27 | 0.37 | 0.36 | 0.19 | 0.12 | 0.15 |
| 90 | 0.41 | 0.4 | 0.25 | 0.12 | 0.13 | 0.15 |
| 91 | 0.73 | 0.92 | 0.81 | 0.79 | 0.7 | 0.92 |
| 92 | 2.51 | 2.42 | 1.97 | 0.05 | 1.33 | 0.18 |
| 93 | 1.09 | 0.98 | 0.97 | 1.04 | 0.37 | 1.2 |
| 94 | 0.4 | 0.53 | 0.51 | 0.27 | 0.37 | 0.21 |
| 95 | 4.12 | 4.45 | 3.5 | 6.71 | 4.94 | 5.96 |
| 96 | 0.14 | 0.12 | 0.1 | 0.09 | 0.05 | 0.1 |
| 97 | 3.37 | 2.1 | 1.4 | 0.95 | 1.25 | 1.56 |
| 98 | 1.99 | 2.47 | 2.04 | 2.92 | 1.89 | 2.94 |
| 99 | 0.15 | 0.15 | 0.15 | 0.36 | 0.54 | 0.26 |
| 100 | 14.23 | 13.32 | 7.24 | 26.65 | 34.2 | 18.47 |
| 101 | 4.95 | 3.97 | 3.21 | 11.73 | 14.1 | 14 |
| 102 | 1.05 | 0.79 | 0.87 | 0.9 | 0.76 | 0.74 |
| 103 | 1.14 | 1.33 | 1.53 | 2.02 | 1.67 | 1.19 |
| 104 | 1.67 | 2.39 | 2.03 | 2.75 | 1.51 | 2.67 |
| 105 | 3.16 | 2.31 | 3.09 | 2.96 | 3 | 2.27 |
| 106 | 2.15 | 3 | 2.27 | 5.14 | 3.34 | 5.86 |
| 107 | 2.03 | 1.92 | 1.85 | 1 | 0.73 | 1.09 |
| 108 | 39.56 | 33.2 | 16.66 | 20.09 | 29.88 | 31.81 |
| 109 | 0.75 | 0.74 | 0.65 | 0.9 | 0.69 | 0.64 |
| 110 | 2.78 | 3.42 | 3.54 | 3.25 | 5.27 | 2.58 |

TABLE 9A-continued

Training Samples: Good outcome patients. (1st bar FIG. 7A)

| | | | | | | |
|---|---|---|---|---|---|---|
| 111 | 41.25 | 65.42 | 26.05 | 39.22 | 20.41 | 50.47 |
| 112 | 9.42 | 11.84 | 3.05 | 7.8 | 8.42 | 11.32 |
| 113 | 7.26 | 10.09 | 8.3 | 2.77 | 7.46 | 3.23 |
| 114 | 1.15 | 1.1 | 1.1 | 0.5 | 1.24 | 0.43 |
| 115 | 1.64 | 1.75 | 1.68 | 2.27 | 1.34 | 2.91 |
| 116 | 0.14 | 0.13 | 0.33 | 0.26 | 0.13 | 0.24 |
| 117 | 0.14 | 0.14 | 0.16 | 0.3 | 0.45 | 0.25 |
| 118 | 1.68 | 1.88 | 2.77 | 2.26 | 7.15 | 5.33 |
| 119 | 4.97 | 5.78 | 5.24 | 8.42 | 5.48 | 10.3 |
| 120 | 0.98 | 0.83 | 0.96 | 0.98 | 1.16 | 0.85 |
| 121 | 1.77 | 1.78 | 2.53 | 1.66 | 2.78 | 4.38 |
| 122 | 4.53 | 7.04 | 7.17 | 4.4 | 5.04 | 5.16 |
| 123 | 2.87 | 3.17 | 2.35 | 3.96 | 2.48 | 5.3 |
| 124 | 1.47 | 2.14 | 1.71 | 1.16 | 1.21 | 1.73 |
| 125 | 66.32 | 45.73 | 41.85 | 32.34 | 40.51 | 45.33 |
| 126 | 12.04 | 9.77 | 5.61 | 3.37 | 1.11 | 6.02 |
| 127 | 1.93 | 3.12 | 2.09 | 1.88 | 3.12 | 2.64 |
| 128 | 0.57 | 0.67 | 0.55 | 1.06 | 0.93 | 0.45 |
| 129 | 1.25 | 1.67 | 1.48 | 2.16 | 2.22 | 2.65 |
| 130 | 17.04 | 32.54 | 12.13 | 21.43 | 9.44 | 41.6 |
| 131 | 5.35 | 4.95 | 2.85 | 3.78 | 10.81 | 2.7 |
| 132 | 3.31 | 4.11 | 4.78 | 4.82 | 7.81 | 4.27 |
| 133 | 2.35 | 2.91 | 3.61 | 10.69 | 5.57 | 14.87 |
| 134 | 1.41 | 1.57 | 1.2 | 2.28 | 1.55 | 3.87 |
| 135 | 0.9 | 1.15 | 1.05 | 1.24 | 0.51 | 1.35 |
| 136 | 0.76 | 0.61 | 1.41 | 0.32 | 0.37 | 0.44 |
| 137 | 0.12 | 0.09 | 0.23 | 0.19 | 0.25 | 0.11 |
| 138 | 1.97 | 2.65 | 2.43 | 2.08 | 2.9 | 1.6 |
| 139 | 0.17 | 0.19 | 0.22 | 2.35 | 0.71 | 1.31 |
| 140 | 59.2 | 53.79 | 62.79 | 4.92 | 6.68 | 12.16 |
| 141 | 2.36 | 3.02 | 3.09 | 5.43 | 6.09 | 3.76 |
| 142 | 1.48 | 2.13 | 2.06 | 1.98 | 3.34 | 1.46 |
| 143 | 3.15 | 4.07 | 3.46 | 4.56 | 5.52 | 3.65 |
| 144 | 2.5 | 2.93 | 2.91 | 1.11 | 0.98 | 1.38 |
| 145 | 0.49 | 0.51 | 0.66 | 0.36 | 0.07 | 0.46 |
| 146 | 6.51 | 9.03 | 7.04 | 5.92 | 10.07 | 8.91 |
| 147 | 0.88 | 0.68 | 0.81 | 0.87 | 0.85 | 0.55 |
| 148 | 6 | 7.78 | 3.13 | 3.74 | 3.66 | 2.94 |
| 149 | 4.22 | 4.67 | 5.03 | 3.73 | 4.92 | 2.8 |
| 150 | 0.4 | 0.37 | 0.41 | 0.21 | 0.64 | 0.2 |
| 151 | 8.04 | 19.13 | 6.18 | 1.67 | 5.44 | 2.77 |
| 152 | 1.23 | 0.95 | 1.1 | 1.31 | 1.17 | 1.33 |
| 153 | 1.07 | 0.93 | 1.02 | 1.42 | 1.26 | 1.32 |
| 154 | 9.39 | 11.4 | 8.19 | 11.61 | 10.34 | 10.46 |
| 155 | 3 | 2.6 | 2.8 | 1.35 | 0.47 | 1.42 |
| 156 | 6.16 | 9.98 | 6.41 | 2.56 | 2.49 | 1.62 |
| 157 | 0.26 | 0.28 | 0.3 | 0.13 | 0.21 | 0.12 |
| 158 | 0.52 | 0.51 | 0.56 | 0.55 | 1.95 | 0.42 |
| 159 | 0.23 | 0.25 | 0.33 | 0.19 | 0.22 | 0.15 |
| 160 | 0.17 | 0.2 | 0.22 | 0.09 | 0.17 | 0.08 |
| 161 | 0.79 | 0.73 | 0.73 | 1.23 | 1.93 | 1.16 |
| 162 | 2.98 | 3.95 | 3.18 | 6.52 | 5.8 | 6.91 |
| 163 | 25.03 | 25.32 | 26.74 | 33.55 | 18.76 | 31 |
| 164 | 2.64 | 3.81 | 3.24 | 9.52 | 5.27 | 7.93 |
| 165 | 0.13 | 0.12 | 0.08 | 0.11 | 0.05 | 0.13 |
| 166 | 5.38 | 5.76 | 5.15 | 10.6 | 8.95 | 8.33 |
| 167 | 85.69 | 91.81 | 74.89 | 28.33 | 54.43 | 100 |
| 168 | 7.76 | 10.95 | 8.1 | 9.4 | 0.15 | 7.38 |
| 169 | 0.01 | 0.01 | 0.01 | 0.03 | 0.01 | 0.01 |
| 170 | 10.14 | 11.84 | 9.66 | 20.01 | 11.83 | 21.22 |
| 171 | 17.16 | 16.87 | 12.45 | 6.09 | 3.05 | 10.16 |
| 172 | 0.28 | 0.15 | 0.27 | 0.3 | 0.29 | 0.19 |
| 173 | 5.58 | 5.5 | 7.9 | 2.54 | 3.16 | 3.17 |
| 174 | 2.52 | 2.7 | 1.85 | 0.79 | 0.59 | 0.95 |
| 175 | 1.7 | 2.1 | 1.05 | 1.09 | 1.33 | 1.19 |
| 176 | 5.12 | 4.69 | 5.42 | 15.16 | 8.55 | 8.94 |
| 177 | 2.43 | 3.47 | 1.96 | 1.23 | 1.98 | 2.67 |
| 178 | 3.28 | 2.71 | 2.85 | 2.47 | 2.95 | 2.15 |
| 179 | 0.55 | 0.5 | 0.93 | 0.72 | 0.4 | 0.44 |
| 180 | 0.45 | 0.44 | 0.43 | 0.29 | 0.17 | 0.31 |
| 181 | 0.61 | 0.69 | 0.74 | 1.18 | 0.89 | 1.23 |
| 182 | 1.72 | 2.03 | 1.46 | 2.1 | 2.92 | 2.33 |
| 183 | 3.19 | 3.58 | 2.08 | 2.05 | 1.88 | 6.59 |
| 184 | 5.34 | 6.31 | 4.96 | 6.14 | 6.47 | 4.27 |
| 185 | 0.54 | 0.42 | 0.43 | 0.31 | 0.47 | 0.2 |
| 186 | 11.94 | 11.85 | 6.55 | 14.91 | 10.39 | 13.12 |
| 187 | 73.69 | 100 | 27.06 | 48.28 | 32.93 | 100 |
| 188 | 3.11 | 2.09 | 1.93 | 1.57 | 1.68 | 2.11 |

TABLE 9A-continued

Training Samples: Good outcome patients. (1st bar FIG. 7A)

| | | | | | |
|---|---|---|---|---|---|
| 189 | 0.18 | 0.23 | 0.22 | 0.12 | 0.15 | 0.11 |
| 190 | 4.25 | 4.48 | 4.69 | 10.17 | 2.97 | 25.02 |
| 191 | 0.32 | 0.51 | 0.6 | 0.55 | 0.13 | 0.35 |
| 192 | 1.18 | 1.41 | 1.38 | 1.67 | 1.67 | 1.08 |
| 193 | 7.23 | 7.13 | 6.78 | 7.1 | 9.45 | 8.62 |
| 194 | 0.41 | 0.34 | 0.37 | 0.31 | 0.24 | 0.23 |
| 195 | 2.28 | 1.78 | 1.67 | 15.35 | 2.04 | 9.14 |
| 196 | 0.8 | 0.83 | 0.78 | 1.61 | 0.44 | 1.32 |
| 197 | 5.56 | 6.9 | 8.15 | 14.68 | 10.27 | 13.24 |
| 198 | 0.6 | 0.5 | 0.53 | 0.31 | 0.16 | 0.45 |
| 199 | 3.97 | 5.6 | 3.3 | 3.99 | 5.19 | 4.04 |
| 200 | 0.13 | 0.12 | 0.09 | 0.13 | 0.05 | 0.13 |
| 201 | 0.13 | 0.17 | 0.23 | 0.15 | 0.09 | 0.13 |
| 202 | 5.89 | 5.54 | 5.57 | 6.59 | 0.22 | 3.55 |
| 203 | 0.56 | 0.54 | 0.53 | 1.3 | 1.02 | 1.24 |
| 204 | 0.81 | 1.05 | 0.91 | 0.52 | 1.24 | 0.54 |
| 205 | 0.69 | 0.66 | 0.55 | 0.71 | 0.75 | 0.53 |
| 206 | 0.92 | 1.21 | 1.16 | 1.5 | 0.48 | 0.69 |
| 207 | 10.78 | 7.94 | 5.9 | 4.17 | 6.58 | 4.33 |
| 208 | 6.78 | 6.01 | 3.85 | 31.48 | 20.26 | 19.38 |
| 209 | 0.1 | 0.1 | 0.11 | 0.1 | 0.12 | 0.1 |
| 210 | 1.54 | 1.63 | 1.5 | 3.24 | 2.4 | 3.97 |
| 211 | 0.31 | 0.32 | 0.44 | 0.3 | 0.66 | 0.26 |
| 212 | 47.36 | 68.52 | 39.55 | 11.34 | 44.85 | 28.79 |
| 213 | 0.25 | 0.24 | 0.22 | 0.23 | 0.07 | 0.25 |
| 214 | 0.64 | 0.81 | 0.8 | 0.28 | 0.54 | 0.31 |
| 215 | 0.68 | 0.41 | 0.57 | 0.28 | 0.15 | 0.24 |
| 216 | 1.92 | 2.09 | 3.05 | 1.36 | 0.98 | 1.29 |
| 217 | 4.91 | 2.9 | 2.41 | 5.36 | 5.9 | 6.73 |
| 218 | 2.81 | 2.68 | 2.31 | 2.02 | 2.56 | 2.17 |
| 219 | 1.13 | 1.37 | 1.08 | 2.35 | 3.16 | 1.32 |
| 220 | 0.16 | 0.14 | 0.24 | 0.1 | 0.22 | 0.08 |
| 221 | 0.58 | 0.63 | 0.97 | 0.99 | 1.17 | 1.21 |
| 222 | 0.59 | 0.68 | 0.69 | 1.05 | 0.32 | 0.95 |
| 223 | 1.74 | 1.61 | 1.89 | 1.4 | 0.94 | 1.09 |
| 224 | 1.14 | 1.22 | 1.48 | 1.57 | 0.97 | 1.11 |
| 225 | 2.29 | 3.28 | 2.91 | 0.98 | 1.82 | 0.66 |
| 226 | 0.89 | 0.66 | 0.64 | 0.85 | 0.58 | 0.75 |
| 227 | 0.95 | 1.09 | 0.63 | 0.39 | 0.44 | 0.34 |
| 228 | 0.76 | 0.69 | 0.79 | 4.89 | 3.08 | 8.24 |
| 229 | 0.73 | 0.77 | 0.65 | 1.17 | 0.48 | 1.03 |
| 230 | 0.08 | 0.07 | 0.14 | 0.08 | 0.13 | 0.04 |
| 231 | 0.22 | 0.25 | 0.45 | 0.31 | 0.16 | 0.24 |
| 232 | 5.56 | 8.75 | 9.99 | 3.76 | 6.28 | 5.47 |
| 233 | 5.47 | 5.94 | 5.63 | 2.18 | 2.23 | 3.87 |
| 234 | 3.13 | 3.08 | 1.73 | 1.63 | 2.03 | 1.41 |
| 235 | 1.05 | 1.3 | 1.46 | 1.5 | 1.78 | 1.28 |
| 236 | 0.72 | 0.69 | 0.68 | 2.33 | 0.49 | 2.79 |
| 237 | 7 | 9.99 | 18.41 | 12.19 | 0.38 | 9.85 |
| 238 | 0.62 | 1.01 | 1.13 | 1.78 | 1.53 | 1.46 |
| 239 | 28 | 26.79 | 15.99 | 37.03 | 27.12 | 40.72 |
| 240 | 17.14 | 16.33 | 14.59 | 18.83 | 21.32 | 23.44 |
| 241 | 0.53 | 0.43 | 0.33 | 0.25 | 0.22 | 0.32 |
| 242 | 2.88 | 2.39 | 2.53 | 2.57 | 3.73 | 2.14 |
| 243 | 2.35 | 2.94 | 2.46 | 2.93 | 3.93 | 2.21 |
| 244 | 0.34 | 0.31 | 0.4 | 0.94 | 0.65 | 0.78 |
| 245 | 4.71 | 3.67 | 3.84 | 5.17 | 6.19 | 5.23 |
| 246 | 5.64 | 4.49 | 5.22 | 4.38 | 6.15 | 5.05 |
| 247 | 11.64 | 11.39 | 8.72 | 7.25 | 7.61 | 8.52 |
| 248 | 1.78 | 2.33 | 1.85 | 2.91 | 4.53 | 1.72 |
| 249 | 6.62 | 6.39 | 4.71 | 3.06 | 6.62 | 9.45 |
| 250 | 2.17 | 3.09 | 2.51 | 3.17 | 4.64 | 2.87 |

TABLE 9B

Training Samples Poor-Outcome patients (2nd Bar of FIG. 7A)

| Rank | Gene | St2_NA_NB18 | St3_A_NB75 | St4_A_NB21 | St4_A_NB254 | St4_A_NB266 | St4_A_NB27 |
|---|---|---|---|---|---|---|---|
| 1 | DLK1 | 5.34 | 0.39 | 6.96 | 3.59 | 0.97 | 2.14 |
| 2 | est | 1.16 | 10.52 | 3.73 | 5.12 | 1.78 | 15.56 |
| 3 | PRSS3 | 4.61 | 32.17 | 7.93 | 13.15 | 4.78 | 1.39 |
| 4 | ARHI | 0.48 | 0.33 | 0.4 | 0.57 | 0.67 | 0.55 |
| 5 | ARC | 4.06 | 7.21 | 7.56 | 12.84 | 2.58 | 3.98 |
| 6 | SLIT3 | 61.76 | 85.49 | 23.26 | 33.29 | 38.92 | 7.43 |

TABLE 9B-continued

Training Samples Poor-Outcome patients (2nd Bar of FIG. 7A)

| | | | | | | | |
|---|---|---|---|---|---|---|---|
| 7 | CNR1 | 0.96 | 1.85 | 1.75 | 0.84 | 2.57 | 4.6 |
| 8 | est | 1.48 | 14.9 | 4.62 | 7.53 | 0.71 | 0.86 |
| 9 | est | 0.43 | 0.13 | 0.07 | 0.11 | 0.47 | 0.27 |
| 10 | FLJ25461 | 1.02 | 0.32 | 0.37 | 0.49 | 0.75 | 0.32 |
| 11 | est | 6.99 | 0.59 | 12.8 | 3.24 | 1.05 | 2.24 |
| 12 | CD44 | 0.56 | 0.16 | 0.2 | 1.17 | 0.68 | 0.12 |
| 13 | est | 2.26 | 0.2 | 0.31 | 0.84 | 1.44 | 4.53 |
| 14 | ROBO2 | 15.52 | 1.02 | 3.08 | 2.13 | 2.8 | 6.52 |
| 15 | BTBD3 | 0.29 | 0.28 | 0.24 | 0.34 | 0.3 | 0.36 |
| 16 | MYCN | 3.6 | 54.67 | 72.43 | 37.8 | 21.24 | 42.7 |
| 17 | est | 4.87 | 2.52 | 2.94 | 4.43 | 5.89 | 2.69 |
| 18 | JPH1 | 0.18 | 0.33 | 0.88 | 0.27 | 0.54 | 0.65 |
| 19 | KLRC3 | 0.04 | 0.03 | 0.05 | 0.17 | 0.09 | 0.04 |
| 20 | est | 25.13 | 50.6 | 40.74 | 11.44 | 33.86 | 34.25 |
| 21 | RET | 6.74 | 22.79 | 1.34 | 28.33 | 2.43 | 1.33 |
| 22 | CRABP1 | 0.09 | 2.46 | 1.37 | 0.41 | 0.11 | 1.21 |
| 23 | ECEL1 | 0.25 | 0.44 | 0.48 | 0.26 | 0.12 | 0.26 |
| 24 | LOC283120 | 17.28 | 3.04 | 5.07 | 7.09 | 1.97 | 1.04 |
| 25 | HMGA2 | 16.26 | 2.86 | 2.18 | 4.76 | 5.55 | 8.7 |
| 26 | SYNPO2 | 14.55 | 23.09 | 37.13 | 60.99 | 31.01 | 7.45 |
| 27 | LOC163782 | 0.05 | 0.06 | 0.12 | 0.07 | 0.08 | 0.06 |
| 28 | VSNL1 | 7.75 | 12.02 | 1.08 | 4.22 | 2.14 | 12.7 |
| 29 | HS3ST4 | 0.04 | 0.08 | 0.07 | 0.06 | 0.09 | 0.06 |
| 30 | AKR1C1 | 0.17 | 0.24 | 0.01 | 0.07 | 0.04 | 0.36 |
| 31 | est | 11.61 | 0.23 | 0.03 | 13.81 | 7.95 | 0.03 |
| 32 | GPR22 | 27.65 | 11.6 | 31.12 | 11.05 | 28.75 | 34.35 |
| 33 | est | 4.81 | 2.72 | 8.39 | 3.02 | 2.88 | 3.12 |
| 34 | est | 0.05 | 0.1 | 0.08 | 0.13 | 0.35 | 0.08 |
| 35 | CCNA1 | 6.65 | 4.62 | 0.81 | 8.89 | 1.94 | 2.86 |
| 36 | PKIB | 0.39 | 1.77 | 0.38 | 3.09 | 1.41 | 0.41 |
| 37 | est | 0.85 | 0.31 | 0.37 | 0.39 | 0.84 | 0.29 |
| 38 | GAL | 8.4 | 2.65 | 12.39 | 6.84 | 2.32 | 12.17 |
| 39 | est | 1 | 1.06 | 1.97 | 1.04 | 0.97 | 3.76 |
| 40 | LOC221303 | 9.52 | 5.7 | 41.43 | 22.71 | 49.92 | 29.62 |
| 41 | est | 7.57 | 20.32 | 6.69 | 9.36 | 5.72 | 1.41 |
| 42 | est | 3.32 | 52.47 | 4.94 | 60.04 | 16.22 | 0.97 |
| 43 | BMP7 | 0.12 | 6.4 | 3 | 9.34 | 1.62 | 1.13 |
| 44 | SLC30A3 | 2.18 | 6.99 | 14.04 | 3.07 | 3.11 | 10.88 |
| 45 | FLJ10539 | 0.32 | 0.32 | 0.29 | 0.92 | 0.34 | 3.31 |
| 46 | AMIGO2 | 0.4 | 0.25 | 0.31 | 0.98 | 2.32 | 0.35 |
| 47 | AKR1C2 | 0.17 | 0.25 | 0.02 | 0.07 | 0.06 | 0.28 |
| 48 | MGP | 0.14 | 0.09 | 0.2 | 0.27 | 0.65 | 0.23 |
| 49 | PCSK1 | 0.2 | 0.17 | 0.27 | 0.23 | 0.17 | 0.23 |
| 50 | HK2 | 1.54 | 2.09 | 4.1 | 1.08 | 0.36 | 0.46 |
| 51 | est | 0.5 | 1.08 | 1.09 | 2.88 | 0.45 | 3.05 |
| 52 | est | 1.54 | 0.51 | 1.44 | 0.56 | 0.22 | 1.39 |
| 53 | IL7 | 2.26 | 0.84 | 0.89 | 1.04 | 1.27 | 0.72 |
| 54 | PRSS12 | 1.35 | 16.31 | 2.6 | 20.99 | 3.36 | 0.72 |
| 55 | GABARAPL1 | 0.17 | 0.12 | 0.51 | 0.36 | 0.57 | 0.15 |
| 56 | DEFB129 | 2.94 | 5.53 | 10.05 | 3.43 | 3.3 | 11.9 |
| 57 | NAV3 | 0.22 | 0.46 | 0.41 | 0.84 | 2.46 | 0.57 |
| 58 | RAB3B | 6.2 | 1.96 | 1.23 | 1.11 | 3.49 | 0.9 |
| 59 | KRT6B | 3.45 | 2.12 | 0.34 | 0.68 | 1.58 | 1.02 |
| 60 | BEX1 | 24.26 | 31.07 | 59.91 | 34.92 | 13.92 | 47.34 |
| 61 | est | 27.18 | 36.94 | 59.77 | 39.76 | 15.3 | 38.99 |
| 62 | est | 2.09 | 0.73 | 0.59 | 0.63 | 0.45 | 0.39 |
| 63 | SCYL1 | 2.53 | 2.18 | 1.21 | 2.59 | 1.85 | 1.36 |
| 64 | est | 1.12 | 1.03 | 0.56 | 1.35 | 1.13 | 0.79 |
| 65 | RYR2 | 9.39 | 2.81 | 8.55 | 4.13 | 6.07 | 16.41 |
| 66 | LRBA | 0.99 | 1.03 | 2.2 | 1.87 | 1.41 | 0.72 |
| 67 | CSPG3 | 1.76 | 7.66 | 0.85 | 2.91 | 1.75 | 10.17 |
| 68 | est | 0.62 | 0.92 | 0.65 | 0.6 | 0.4 | 0.9 |
| 69 | MMP12 | 23.54 | 31.92 | 6.4 | 13.35 | 10.9 | 1.4 |
| 70 | CHRNA1 | 0.02 | 0.02 | 0.03 | 0.04 | 0.05 | 0.03 |
| 71 | est | 3.53 | 1.08 | 0.73 | 1.54 | 1.33 | 1.15 |
| 72 | est | 14.9 | 4.6 | 4.01 | 6.09 | 6.71 | 10.92 |
| 73 | HNRPH1 | 62.09 | 46.23 | 6.31 | 87.81 | 96.22 | 12.8 |
| 74 | LOC113251 | 0.86 | 0.44 | 0.28 | 0.26 | 0.5 | 0.72 |
| 75 | est | 1.06 | 0.86 | 0.49 | 0.95 | 2.17 | 2.82 |
| 76 | PAG | 2.14 | 2.22 | 1.29 | 2.16 | 1.52 | 1.18 |
| 77 | PROK2 | 17.38 | 1.6 | 7.17 | 3.15 | 4.98 | 9.2 |
| 78 | HS6ST1 | 6.39 | 6.04 | 0.86 | 9.28 | 2.32 | 3.19 |
| 79 | est | 9.82 | 2.13 | 1.27 | 2.11 | 8.75 | 6.75 |
| 80 | PCDH9 | 3.43 | 1.63 | 0.45 | 2.69 | 1.31 | 6.81 |
| 81 | est | 25.52 | 28.46 | 14.05 | 20.05 | 27.98 | 5.14 |
| 82 | est | 0.58 | 0.16 | 0.12 | 0.15 | 0.24 | 0.17 |
| 83 | GLDC | 0.31 | 6.41 | 0.39 | 2.25 | 0.98 | 1.06 |
| 84 | ADRB2 | 0.24 | 0.26 | 0.35 | 0.45 | 0.67 | 0.54 |

TABLE 9B-continued

Training Samples Poor-Outcome patients (2nd Bar of FIG. 7A)

| | | | | | | | |
|---|---|---|---|---|---|---|---|
| 85 | ICSBP1 | 6.96 | 2 | 6.77 | 7.93 | 1.2 | 3.79 |
| 86 | CD48 | 0.25 | 0.11 | 0.14 | 0.84 | 0.53 | 0.09 |
| 87 | est | 0.56 | 0.44 | 0.43 | 1.19 | 0.62 | 2.61 |
| 88 | DYRK1B | 0.9 | 4.79 | 2.22 | 2.33 | 1.05 | 5.56 |
| 89 | KLRC1 | 0.06 | 0.07 | 0.05 | 0.21 | 0.1 | 0.06 |
| 90 | est | 0.42 | 1.01 | 1.96 | 1.39 | 0.9 | 1.06 |
| 91 | est | 3.09 | 4.04 | 6.11 | 4.15 | 4.18 | 2.39 |
| 92 | est | 0.95 | 0.99 | 4.22 | 1.94 | 0.73 | 2.86 |
| 93 | MOXD1 | 0.09 | 0.09 | 0.12 | 0.58 | 0.67 | 0.12 |
| 94 | est | 1.06 | 1.64 | 2.98 | 1.89 | 1.32 | 1.88 |
| 95 | est | 2.14 | 0.4 | 0.51 | 2.44 | 2.4 | 8.86 |
| 96 | GAS1 | 0.06 | 0.02 | 0.05 | 0.05 | 1.24 | 0.06 |
| 97 | COL9A2 | 4.02 | 0.42 | 0.33 | 0.28 | 0.27 | 0.35 |
| 98 | est | 1.04 | 0.72 | 0.47 | 0.71 | 1.05 | 2.41 |
| 99 | DRPLA | 0.16 | 0.19 | 0.03 | 0.07 | 0.05 | 0.24 |
| 100 | est | 8.66 | 5.79 | 1.1 | 4.15 | 12.41 | 5.53 |
| 101 | REPRIMO | 1.28 | 1.82 | 1.45 | 2.39 | 2.76 | 11.99 |
| 102 | CACNA2D2 | 2.52 | 4.16 | 7.74 | 3.14 | 2.78 | 9.26 |
| 103 | NEBL | 0.7 | 0.31 | 0.48 | 0.42 | 0.92 | 2 |
| 104 | est | 0.3 | 0.19 | 0.28 | 0.75 | 2.05 | 0.51 |
| 105 | HLA-DQA1 | 1.13 | 0.48 | 0.47 | 5.01 | 2.34 | 0.52 |
| 106 | EDG3 | 8.04 | 15.81 | 23.13 | 23.18 | 5.64 | 4.23 |
| 107 | CPVL | 0.3 | 0.19 | 0.31 | 1.19 | 0.86 | 0.24 |
| 108 | FLJ32884 | 7.57 | 2.16 | 4.64 | 5.17 | 16.88 | 3.71 |
| 109 | LCP1 | 0.41 | 0.11 | 0.2 | 1.01 | 0.76 | 0.17 |
| 110 | est | 0.86 | 0.92 | 0.59 | 1.12 | 0.6 | 0.62 |
| 111 | est | 46.81 | 67.42 | 40.27 | 93.36 | 13.93 | 44.96 |
| 112 | est | 3.92 | 4.25 | 1.82 | 1.19 | 2.77 | 3.44 |
| 113 | est | 2.31 | 1.64 | 0.97 | 1.06 | 1.37 | 1.27 |
| 114 | DKFZP564C152 | 4.58 | 1.7 | 11.74 | 2.47 | 1.39 | 2.62 |
| 115 | DMN | 0.78 | 0.36 | 0.83 | 0.7 | 0.58 | 0.67 |
| 116 | GABRA5 | 0.19 | 0.85 | 2.02 | 0.44 | 0.98 | 0.54 |
| 117 | AKR1C3 | 0.11 | 0.19 | 0.04 | 0.06 | 0.07 | 0.15 |
| 118 | LOC168850 | 4.1 | 2.14 | 0.54 | 1.29 | 2.43 | 1.03 |
| 119 | est | 1.58 | 0.94 | 1.07 | 2.47 | 3.46 | 1.43 |
| 120 | KCNQ2 | 4.05 | 2.8 | 6.7 | 2.12 | 1.19 | 1.91 |
| 121 | NME5 | 2.36 | 3.87 | 2.26 | 1.64 | 3.34 | 2.75 |
| 122 | est | 1.42 | 0.95 | 1.13 | 0.95 | 1.23 | 1.17 |
| 123 | PBX1 | 1.1 | 1.11 | 0.55 | 0.8 | 1.29 | 2.93 |
| 124 | CNTNAP2 | 0.66 | 0.52 | 0.4 | 0.79 | 1.02 | 0.8 |
| 125 | est | 9.83 | 21.2 | 0.71 | 12.86 | 2.67 | 0.82 |
| 126 | SPON1 | 2.25 | 4.27 | 20.56 | 5.81 | 32.07 | 2.77 |
| 127 | CDH8 | 0.93 | 1.12 | 0.37 | 0.65 | 0.61 | 0.47 |
| 128 | PRKCB1 | 0.32 | 0.12 | 0.34 | 0.4 | 0.32 | 0.54 |
| 129 | SLC21A11 | 1.56 | 0.35 | 1.43 | 1.12 | 1.59 | 0.85 |
| 130 | MAP4 | 8.43 | 16.27 | 2.16 | 4.78 | 3.49 | 22.39 |
| 131 | est | 4.26 | 0.98 | 1.2 | 2.18 | 4.16 | 2.07 |
| 132 | SCN7A | 1.53 | 1.71 | 0.95 | 0.56 | 1.24 | 2.4 |
| 133 | est | 1.02 | 1.1 | 0.68 | 1.15 | 1.35 | 5.99 |
| 134 | est | 1.03 | 0.7 | 0.78 | 0.71 | 1.82 | 1.24 |
| 135 | est | 0.61 | 0.33 | 0.23 | 0.34 | 0.4 | 0.64 |
| 136 | est | 0.66 | 3.04 | 1.11 | 1.93 | 0.51 | 2.42 |
| 137 | CDW52 | 0.1 | 0.06 | 0.07 | 0.52 | 0.26 | 0.06 |
| 138 | ABCB1 | 6.37 | 4.83 | 8.56 | 6.38 | 3.1 | 1.22 |
| 139 | est | 0.17 | 0.2 | 0.3 | 0.35 | 0.19 | 0.59 |
| 140 | OSF-2 | 21.65 | 31.52 | 7.76 | 100 | 48.2 | 3.42 |
| 141 | NRXN1 | 1.59 | 0.94 | 0.49 | 0.69 | 0.51 | 0.38 |
| 142 | ADAM22 | 3.35 | 10.38 | 10.35 | 5.79 | 3.55 | 3.58 |
| 143 | est | 32.13 | 13.97 | 18.2 | 13.34 | 12.09 | 8.19 |
| 144 | TRGV9 | 0.3 | 0.35 | 0.26 | 1.16 | 1.16 | 0.35 |
| 145 | est | 0.21 | 0.07 | 0.04 | 7.47 | 2.75 | 0.03 |
| 146 | PTPRD | 4.98 | 4.68 | 1.01 | 1.13 | 2.77 | 2.74 |
| 147 | est | 0.89 | 1.22 | 0.64 | 1.32 | 0.98 | 0.58 |
| 148 | HS3ST2 | 10.47 | 4.65 | 24.13 | 12.69 | 3.13 | 1.9 |
| 149 | FGF13 | 3.61 | 4.16 | 1.08 | 1.5 | 1.13 | 3.69 |
| 150 | MKI67 | 1.03 | 1.26 | 0.82 | 1.42 | 1.19 | 1.31 |
| 151 | KIF12 | 0.99 | 1.75 | 0.92 | 1.98 | 1.43 | 0.99 |
| 152 | est | 2.51 | 3.39 | 2.33 | 3.93 | 2.41 | 12.54 |
| 153 | est | 0.3 | 0.16 | 0.33 | 1.16 | 1.19 | 0.23 |
| 154 | est | 2.85 | 1.73 | 0.73 | 7.93 | 7.96 | 0.81 |
| 155 | est | 0.81 | 0.81 | 0.21 | 20.91 | 5.82 | 0.15 |
| 156 | est | 1.83 | 0.77 | 0.51 | 1.07 | 0.78 | 0.94 |
| 157 | KLIP1 | 1.03 | 1 | 0.93 | 0.92 | 0.86 | 1.41 |
| 158 | est | 1.83 | 0.8 | 2 | 0.76 | 2.26 | 0.89 |
| 159 | LOC157570 | 0.64 | 0.77 | 1.07 | 0.75 | 0.73 | 1.07 |
| 160 | MAD2L1 | 0.5 | 0.68 | 0.99 | 0.68 | 0.37 | 0.97 |
| 161 | est | 1.21 | 0.26 | 0.76 | 0.61 | 0.4 | 0.29 |
| 162 | est | 5.82 | 1.57 | 1.56 | 1.5 | 2.68 | 5.42 |

TABLE 9B-continued

Training Samples Poor-Outcome patients (2nd Bar of FIG. 7A)

| | | | | | | | |
|---|---|---|---|---|---|---|---|
| 163 | RGS5 | 60.33 | 9.32 | 44.35 | 67.04 | 13.44 | 21.18 |
| 164 | ATP2B4 | 0.61 | 1.38 | 0.61 | 0.94 | 0.84 | 1.02 |
| 165 | HMGCL | 0.07 | 0.04 | 0.05 | 0.07 | 0.14 | 0.03 |
| 166 | ODZ3 | 0.94 | 2.55 | 0.91 | 3.97 | 0.96 | 4.27 |
| 167 | CHGA | 100 | 100 | 97.08 | 100 | 32.96 | 25.79 |
| 168 | MGC33510 | 6.2 | 0.26 | 0.18 | 7.51 | 5.72 | 0.12 |
| 169 | GAGE5 | 0.03 | 0.01 | 0.02 | 0.02 | 0.01 | 0.05 |
| 170 | SARDH | 7.96 | 2.74 | 1.32 | 3.57 | 3.73 | 8.46 |
| 171 | est | 0.91 | 1.33 | 0.94 | 5.73 | 56.13 | 0.96 |
| 172 | DAT1 | 0.49 | 3.12 | 0.51 | 4.91 | 0.9 | 1.49 |
| 173 | FUCA1 | 1.99 | 0.46 | 0.37 | 2.65 | 2.82 | 0.5 |
| 174 | TM6SF2 | 5.69 | 3.17 | 1.87 | 1.78 | 5.35 | 1.53 |
| 175 | KCNK9 | 5.27 | 4.04 | 5.45 | 4.63 | 1.97 | 2.58 |
| 176 | ADCYAP1 | 0.57 | 0.98 | 0.87 | 5.26 | 0.79 | 0.53 |
| 177 | PLXNA4 | 3.14 | 0.79 | 1.41 | 0.93 | 1.22 | 1.22 |
| 178 | HLA-DMB | 1.28 | 0.47 | 0.32 | 4.65 | 2.2 | 0.46 |
| 179 | est | 1.15 | 0.27 | 0.26 | 0.43 | 0.9 | 0.98 |
| 180 | est | 0.17 | 0.07 | 0.08 | 0.44 | 1.14 | 0.08 |
| 181 | GRIN3A | 0.35 | 0.42 | 0.63 | 0.61 | 0.53 | 0.75 |
| 182 | OSBPL3 | 0.65 | 0.63 | 0.69 | 1.38 | 1.33 | 1.52 |
| 183 | ODZ4 | 5.41 | 25.84 | 1.78 | 6.23 | 4.31 | 1.98 |
| 184 | est | 2.07 | 1.67 | 3.14 | 1.14 | 2.05 | 2.63 |
| 185 | E2F1 | 1.24 | 1.89 | 1.32 | 1.48 | 1.65 | 1.51 |
| 186 | MGC16664 | 15.6 | 40.99 | 14.22 | 11.1 | 20.57 | 23.76 |
| 187 | HMP19 | 100 | 100 | 100 | 100 | 22.17 | 86.03 |
| 188 | IL2RB | 1.38 | 0.42 | 0.54 | 3.17 | 1.94 | 0.57 |
| 189 | TOPK | 0.49 | 0.49 | 0.74 | 0.69 | 0.45 | 0.73 |
| 190 | ALDH1A1 | 1.18 | 0.98 | 1.26 | 5.89 | 4.82 | 1.65 |
| 191 | CED-6 | 3.52 | 1.12 | 5.77 | 2.69 | 1.93 | 0.75 |
| 192 | est | 1.02 | 0.52 | 0.63 | 0.3 | 0.41 | 1.12 |
| 193 | A2BP1 | 1.66 | 2.33 | 1.16 | 0.74 | 1.4 | 1.64 |
| 194 | LY6E | 3.2 | 0.44 | 4.08 | 1.83 | 0.78 | 1.14 |
| 195 | est | 1.07 | 0.89 | 0.77 | 1.37 | 1.96 | 0.96 |
| 196 | est | 0.36 | 0.18 | 0.32 | 0.45 | 1.42 | 0.91 |
| 197 | PLXNC1 | 1.51 | 3.05 | 1.07 | 3.61 | 3.03 | 2.47 |
| 198 | EFS | 0.31 | 0.9 | 1.77 | 1.86 | 3.12 | 0.48 |
| 199 | ACTN2 | 3.95 | 0.36 | 0.36 | 2.09 | 0.79 | 1.63 |
| 200 | MYC | 0.08 | 0.04 | 0.04 | 0.07 | 0.16 | 0.03 |
| 201 | KIAA0527 | 0.3 | 0.41 | 0.94 | 0.99 | 1.07 | 1.66 |
| 202 | C6orf31 | 5.65 | 0.31 | 0.2 | 6.29 | 5.12 | 0.15 |
| 203 | DLL3 | 1.58 | 5.19 | 4.11 | 6.96 | 1.58 | 6.09 |
| 204 | est | 2.14 | 4.67 | 4.57 | 1.48 | 1.03 | 1.79 |
| 205 | STK33 | 0.62 | 1.22 | 2.7 | 1.65 | 0.67 | 1.14 |
| 206 | SEMA3A | 0.13 | 0.64 | 0.14 | 0.44 | 0.81 | 0.34 |
| 207 | est | 3.3 | 4.99 | 0.84 | 2.07 | 4 | 0.52 |
| 208 | IGSF4 | 7.22 | 9.19 | 1.28 | 3.46 | 5.55 | 9.74 |
| 209 | CKS2 | 0.27 | 0.58 | 0.81 | 0.54 | 0.32 | 0.46 |
| 210 | est | 0.98 | 1.28 | 0.84 | 0.44 | 0.57 | 1.2 |
| 211 | est | 1.36 | 1.65 | 1.08 | 1.26 | 2.07 | 1.43 |
| 212 | SIX3 | 2.87 | 71.85 | 1.08 | 5.05 | 6.25 | 31.73 |
| 213 | FLJ22002 | 0.07 | 0.06 | 0.07 | 0.09 | 0.09 | 0.06 |
| 214 | HSD17B12 | 1.21 | 1.01 | 3.1 | 1.74 | 0.93 | 1.14 |
| 215 | HBA2 | 1.15 | 1.46 | 0.44 | 1.66 | 2.81 | 0.53 |
| 216 | CDH11 | 0.68 | 0.51 | 0.45 | 1.35 | 4.09 | 0.52 |
| 217 | RGS9 | 1.49 | 0.91 | 0.61 | 0.9 | 0.81 | 1.13 |
| 218 | est | 1.59 | 0.54 | 1.36 | 1.27 | 1.72 | 1.36 |
| 219 | NCAM2 | 5.96 | 1.27 | 0.49 | 1.23 | 2.27 | 5.36 |
| 220 | BIRC5 | 0.52 | 0.82 | 0.7 | 0.31 | 0.31 | 0.61 |
| 221 | est | 4.02 | 0.66 | 0.51 | 0.81 | 1.28 | 1.35 |
| 222 | GNG12 | 0.31 | 0.16 | 0.42 | 0.5 | 0.96 | 0.19 |
| 223 | GPIG4 | 0.42 | 0.3 | 0.2 | 1.01 | 0.85 | 1.15 |
| 224 | est | 1.7 | 11.89 | 3.4 | 12.57 | 3.47 | 1.87 |
| 225 | ENPP4 | 3.51 | 4.1 | 0.48 | 2.86 | 1.65 | 0.28 |
| 226 | FMNL | 2.91 | 2.38 | 4.18 | 2.81 | 2.73 | 1.68 |
| 227 | est | 0.06 | 0.13 | 0.17 | 0.19 | 0.16 | 0.37 |
| 228 | PIWIL2 | 1.09 | 0.56 | 0.73 | 0.62 | 0.53 | 7.85 |
| 229 | CLSTN1 | 0.39 | 0.31 | 0.15 | 0.16 | 0.3 | 0.29 |
| 230 | UHRF1 | 0.23 | 0.57 | 0.3 | 0.08 | 0.11 | 0.26 |
| 231 | est | 0.45 | 0.05 | 0.15 | 0.29 | 0.6 | 0.19 |
| 232 | SLC40A1 | 2.25 | 0.84 | 1.18 | 3.05 | 2.23 | 2.81 |
| 233 | CLECSF6 | 3.15 | 0.96 | 3.16 | 5.22 | 6.26 | 1.4 |
| 234 | est | 3.13 | 9.35 | 3.42 | 3.37 | 3.22 | 5.68 |
| 235 | BKLHD2 | 4.31 | 8.55 | 3.29 | 4.57 | 2.58 | 4.96 |
| 236 | est | 0.52 | 0.33 | 0.4 | 0.7 | 0.98 | 0.32 |
| 237 | est | 8.45 | 0.54 | 0.54 | 9.93 | 12.67 | 0.4 |
| 238 | est | 0.91 | 0.31 | 0.51 | 0.39 | 0.63 | 1.36 |
| 239 | SORCS1 | 1.1 | 13.82 | 1.28 | 24.72 | 1.91 | 17.57 |
| 240 | NRP2 | 8.02 | 1.97 | 4.82 | 8.9 | 16.36 | 6.09 |

TABLE 9B-continued

Training Samples Poor-Outcome patients (2nd Bar of FIG. 7A)

| | | | | | | |
|---|---|---|---|---|---|---|
| 241 | E2-EPF | 0.73 | 1.25 | 1.76 | 1.34 | 0.36 | 1.22 |
| 242 | CAST | 1.76 | 0.45 | 0.29 | 3.13 | 2.73 | 0.64 |
| 243 | KIAA1384 | 0.91 | 0.77 | 0.56 | 0.81 | 0.96 | 0.56 |
| 244 | KIAA0644 | 0.85 | 0.28 | 0.14 | 0.21 | 0.65 | 0.28 |
| 245 | HLA-DRB3 | 2.13 | 0.45 | 0.66 | 4.23 | 4.74 | 0.86 |
| 246 | PMP22 | 5.9 | 1.07 | 3.04 | 1.92 | 2.59 | 4.15 |
| 247 | DJ79P11.1 | 6.93 | 11.41 | 24.48 | 12.38 | 7.27 | 14.69 |
| 248 | SOX5 | 0.85 | 0.93 | 0.44 | 0.5 | 1.02 | 0.85 |
| 249 | CD3E | 19.65 | 7.23 | 7.63 | 12.37 | 4.03 | 2.26 |
| 250 | est | 0.79 | 1.04 | 0.3 | 0.59 | 0.61 | 0.42 |

| Rank | St4_A_NB278 | St4_A_NB79 | St4_NA_NB205 | St4_NA_NB207 | St4_NA_NB209 | St4_NA_NB210 |
|---|---|---|---|---|---|---|
| 1 | 0.04 | 1.72 | 0.11 | 0.52 | 5.08 | 5.03 |
| 2 | 0.55 | 4 | 1.14 | 1.09 | 2.7 | 3.6 |
| 3 | 11.25 | 11.65 | 6.93 | 9.83 | 6.46 | 4.73 |
| 4 | 1.27 | 0.53 | 0.56 | 4.25 | 0.67 | 0.83 |
| 5 | 5.03 | 8.48 | 3.21 | 27.46 | 57.24 | 1.7 |
| 6 | 45.06 | 38.69 | 26.47 | 61.8 | 56.04 | 45.74 |
| 7 | 3.77 | 0.65 | 1.57 | 1.4 | 1.84 | 4.68 |
| 8 | 3.82 | 5.16 | 0.14 | 0.25 | 0.45 | 5.74 |
| 9 | 0.15 | 0.08 | 2.29 | 0.35 | 1.07 | 0.5 |
| 10 | 0.45 | 0.44 | 0.26 | 0.56 | 0.68 | 0.38 |
| 11 | 0.13 | 1.74 | 0.28 | 0.55 | 4.05 | 4.55 |
| 12 | 0.3 | 0.25 | 1.61 | 2.33 | 0.61 | 0.52 |
| 13 | 4.61 | 2.01 | 0.09 | 0.13 | 0.15 | 1.12 |
| 14 | 0.76 | 0.71 | 0.39 | 0.92 | 4.37 | 5.76 |
| 15 | 0.62 | 0.25 | 0.4 | 0.33 | 0.37 | 0.37 |
| 16 | 45.64 | 87.87 | 5.61 | 1.83 | 3.02 | 4.98 |
| 17 | 1.74 | 1.64 | 6.5 | 2.39 | 1.66 | 4.57 |
| 18 | 0.22 | 0.59 | 0.23 | 0.13 | 0.28 | 0.2 |
| 19 | 0.05 | 0.06 | 0.06 | 0.05 | 0.09 | 0.03 |
| 20 | 34.11 | 34.43 | 5.94 | 4.73 | 9.44 | 58.72 |
| 21 | 17.47 | 7.41 | 0.92 | 23.8 | 25.05 | 15.16 |
| 22 | 7.18 | 1.21 | 0.1 | 0.17 | 0.15 | 0.19 |
| 23 | 0.85 | 0.25 | 1.22 | 0.21 | 0.29 | 0.28 |
| 24 | 0.98 | 7.6 | 0.88 | 1.19 | 22.26 | 16.32 |
| 25 | 2.54 | 1.01 | 6.58 | 4.38 | 2 | 6.57 |
| 26 | 81.74 | 81.35 | 10.74 | 15.96 | 26.48 | 27.77 |
| 27 | 0.16 | 0.13 | 0.09 | 0.1 | 0.08 | 0.08 |
| 28 | 4.49 | 9.26 | 2.48 | 4.38 | 2.9 | 5.4 |
| 29 | 0.08 | 0.06 | 0.08 | 0.16 | 0.11 | 0.1 |
| 30 | 0.26 | 0.13 | 0.37 | 0.4 | 0.03 | 0.11 |
| 31 | 9.71 | 0.13 | 9.66 | 0.06 | 4.16 | 13.18 |
| 32 | 1.78 | 8.44 | 28.04 | 11.47 | 51.2 | 63.52 |
| 33 | 3.23 | 2.45 | 2.54 | 6.65 | 3.54 | 3.7 |
| 34 | 0.17 | 0.09 | 0.48 | 0.14 | 0.07 | 0.03 |
| 35 | 2.5 | 2.48 | 13.18 | 15.32 | 8.31 | 6.82 |
| 36 | 1.39 | 1.65 | 2.73 | 1.35 | 0.99 | 2.51 |
| 37 | 0.78 | 0.32 | 0.32 | 0.66 | 0.8 | 0.6 |
| 38 | 1.61 | 2.76 | 0.11 | 0.26 | 1.77 | 3.83 |
| 39 | 1.76 | 1.8 | 1.46 | 12.63 | 4.74 | 0.46 |
| 40 | 11.03 | 3.7 | 4.13 | 4.24 | 5.49 | 14.45 |
| 41 | 8.85 | 4.09 | 2.56 | 5.32 | 5.14 | 3.58 |
| 42 | 11.9 | 92.78 | 0.71 | 1.56 | 7.68 | 10.73 |
| 43 | 6.87 | 3.8 | 5 | 3.26 | 3.25 | 0.29 |
| 44 | 2.25 | 6.42 | 0.36 | 0.57 | 3.21 | 0.96 |
| 45 | 0.5 | 0.68 | 0.46 | 0.15 | 0.36 | 0.33 |
| 46 | 0.3 | 0.56 | 0.78 | 0.71 | 0.8 | 1.86 |
| 47 | 0.31 | 0.13 | 0.39 | 0.47 | 0.04 | 0.12 |
| 48 | 0.05 | 0.41 | 0.25 | 0.38 | 0.03 | 0.07 |
| 49 | 0.22 | 0.06 | 0.11 | 0.46 | 0.09 | 0.15 |
| 50 | 1.38 | 0.78 | 0.17 | 0.2 | 2.14 | 2.32 |
| 51 | 0.95 | 0.58 | 0.66 | 1.93 | 4.35 | 0.86 |
| 52 | 0.62 | 0.75 | 0.42 | 9.85 | 2.24 | 1.29 |
| 53 | 0.7 | 1.11 | 8.25 | 1.12 | 4.78 | 2.9 |
| 54 | 5.19 | 30.7 | 0.66 | 0.91 | 3.73 | 5.25 |
| 55 | 0.28 | 0.25 | 0.83 | 1.74 | 0.56 | 0.57 |
| 56 | 3.51 | 5.87 | 0.66 | 0.67 | 3.34 | 0.79 |
| 57 | 1.47 | 0.45 | 3.37 | 1.87 | 0.77 | 0.59 |
| 58 | 1 | 2.3 | 3.51 | 6.99 | 8.3 | 12.63 |
| 59 | 0.5 | 1.17 | 1 | 1.38 | 1.3 | 1.96 |
| 60 | 36.17 | 36.6 | 25.84 | 41.96 | 19.43 | 17.7 |
| 61 | 41.25 | 31.99 | 26.17 | 43.09 | 22.7 | 18.16 |
| 62 | 1.2 | 5.35 | 0.31 | 1 | 0.22 | 0.92 |
| 63 | 1.38 | 0.86 | 1.16 | 2.25 | 1.57 | 3.83 |
| 64 | 3.21 | 1.17 | 4.29 | 2.28 | 1.82 | 1.49 |
| 65 | 2.42 | 0.89 | 3.16 | 2.12 | 9.89 | 6.41 |

TABLE 9B-continued

| Training Samples Poor-Outcome patients (2nd Bar of FIG. 7A) | | | | | | |
|---|---|---|---|---|---|---|
| 66 | 0.65 | 5.24 | 0.62 | 0.66 | 1.43 | 2.26 |
| 67 | 7.68 | 4.56 | 3 | 0.8 | 4.13 | 1.21 |
| 68 | 0.54 | 0.29 | 3.88 | 0.41 | 0.6 | 0.57 |
| 69 | 3.36 | 4.43 | 5.51 | 3.85 | 56.24 | 6.37 |
| 70 | 0.02 | 0.02 | 0.04 | 0.02 | 0.02 | 0.03 |
| 71 | 5.27 | 0.86 | 0.88 | 1.72 | 1.17 | 1.82 |
| 72 | 39.4 | 5.98 | 13.52 | 3.61 | 12.07 | 9.43 |
| 73 | 19.17 | 15.48 | 8.1 | 17.87 | 100 | 85.58 |
| 74 | 0.42 | 0.39 | 0.49 | 0.53 | 0.46 | 0.74 |
| 75 | 3.15 | 1.3 | 1.36 | 1.05 | 0.87 | 1.92 |
| 76 | 1.36 | 0.69 | 0.96 | 1.89 | 1.46 | 3.56 |
| 77 | 1.44 | 1.95 | 2 | 1.84 | 5.33 | 8.84 |
| 78 | 3.13 | 3.42 | 15.77 | 15.9 | 9.86 | 8.33 |
| 79 | 1.8 | 1.05 | 4.7 | 3.32 | 4.93 | 4.91 |
| 80 | 16.91 | 1.11 | 4.2 | 2.67 | 5.95 | 8.74 |
| 81 | 26.96 | 34.02 | 25.67 | 15.06 | 18.46 | 20.83 |
| 82 | 0.08 | 0.84 | 0.12 | 0.13 | 0.2 | 0.38 |
| 83 | 4.17 | 4.43 | 0.98 | 0.76 | 0.95 | 0.63 |
| 84 | 0.22 | 0.43 | 2.96 | 0.51 | 0.38 | 0.35 |
| 85 | 1.29 | 2.05 | 0.16 | 0.38 | 1.55 | 2.66 |
| 86 | 0.06 | 0.2 | 0.47 | 0.22 | 0.5 | 0.18 |
| 87 | 0.74 | 0.34 | 0.72 | 0.33 | 0.94 | 0.76 |
| 88 | 0.42 | 2.11 | 0.79 | 0.99 | 1.32 | 1.67 |
| 89 | 0.09 | 0.07 | 0.12 | 0.11 | 0.14 | 0.08 |
| 90 | 0.86 | 2.25 | 0.19 | 0.17 | 0.8 | 0.15 |
| 91 | 1.69 | 5.1 | 1.59 | 0.92 | 4.96 | 5.03 |
| 92 | 3.83 | 1.95 | 1.44 | 0.18 | 2.41 | 0.86 |
| 93 | 0.08 | 0.38 | 0.37 | 0.84 | 0.18 | 0.16 |
| 94 | 1.24 | 1.54 | 0.82 | 0.25 | 0.98 | 1.97 |
| 95 | 4.12 | 1.38 | 6.85 | 2.29 | 1.83 | 3.3 |
| 96 | 0.03 | 0.07 | 0.05 | 0.09 | 0.03 | 0.02 |
| 97 | 0.26 | 0.56 | 0.28 | 0.55 | 0.86 | 1.31 |
| 98 | 2.17 | 0.54 | 0.37 | 0.95 | 1.25 | 1.74 |
| 99 | 0.2 | 0.13 | 0.3 | 0.36 | 0.05 | 0.12 |
| 100 | 31.65 | 3.39 | 13.22 | 2.94 | 4.46 | 9.48 |
| 101 | 1.91 | 2.01 | 13.52 | 2.02 | 1.58 | 3.16 |
| 102 | 3.28 | 4.77 | 0.81 | 0.83 | 2.8 | 0.81 |
| 103 | 0.79 | 0.55 | 0.25 | 1.07 | 0.43 | 0.8 |
| 104 | 1.47 | 0.12 | 2.63 | 1.12 | 1.88 | 1.35 |
| 105 | 0.18 | 1.51 | 1.57 | 1.82 | 0.47 | 0.38 |
| 106 | 3.92 | 21.39 | 4.37 | 2.8 | 2.69 | 8.68 |
| 107 | 0.09 | 0.71 | 0.57 | 0.53 | 0.28 | 0.17 |
| 108 | 1.6 | 1.61 | 8.75 | 4.32 | 13.52 | 17.6 |
| 109 | 0.06 | 0.35 | 0.65 | 0.23 | 0.37 | 0.38 |
| 110 | 4.85 | 0.55 | 0.62 | 0.44 | 1.32 | 0.54 |
| 111 | 88.63 | 52.92 | 30.49 | 72.9 | 62.1 | 66.86 |
| 112 | 6.55 | 3.14 | 7.69 | 1.15 | 1.01 | 1.74 |
| 113 | 1.48 | 1.37 | 1.67 | 1.32 | 2.17 | 2.28 |
| 114 | 2.95 | 1.76 | 1.63 | 4.83 | 2.06 | 2.48 |
| 115 | 0.44 | 0.27 | 0.62 | 2.31 | 0.6 | 1.19 |
| 116 | 0.75 | 5.39 | 0.14 | 0.25 | 0.25 | 0.15 |
| 117 | 0.21 | 0.11 | 0.25 | 0.3 | 0.04 | 0.08 |
| 118 | 0.5 | 0.97 | 2.6 | 1.52 | 2.28 | 3.61 |
| 119 | 0.7 | 1.47 | 3.67 | 4.87 | 1.57 | 2.76 |
| 120 | 3.15 | 5.98 | 1.19 | 0.67 | 2.9 | 3.3 |
| 121 | 3.94 | 2.31 | 6 | 20.86 | 4.82 | 9.6 |
| 122 | 0.63 | 0.65 | 1.86 | 1.55 | 3.75 | 3.92 |
| 123 | 2.28 | 2.53 | 1.28 | 0.67 | 0.46 | 1.22 |
| 124 | 0.43 | 0.47 | 1.31 | 0.46 | 0.48 | 0.56 |
| 125 | 50.83 | 0.78 | 14.27 | 22.65 | 1.93 | 5.15 |
| 126 | 2.95 | 5.81 | 4.54 | 4.23 | 20.13 | 6.77 |
| 127 | 4.82 | 0.57 | 0.44 | 0.44 | 1.24 | 0.49 |
| 128 | 0.29 | 0.12 | 0.69 | 0.36 | 0.49 | 0.39 |
| 129 | 0.29 | 0.38 | 2.16 | 0.5 | 1.25 | 1.88 |
| 130 | 3.84 | 1.71 | 21.34 | 9.36 | 3.14 | 11.62 |
| 131 | 3.4 | 0.9 | 1.85 | 1.19 | 1.77 | 2.83 |
| 132 | 2.39 | 1.11 | 1.55 | 7 | 1.82 | 2.19 |
| 133 | 1.5 | 4.77 | 3.26 | 0.89 | 1.16 | 2.04 |
| 134 | 1.16 | 0.92 | 1.32 | 0.63 | 0.82 | 1.16 |
| 135 | 0.24 | 0.24 | 1.19 | 0.29 | 0.58 | 0.54 |
| 136 | 3.33 | 6.99 | 1.01 | 0.67 | 0.89 | 0.42 |
| 137 | 0.04 | 0.05 | 0.14 | 0.07 | 0.26 | 0.05 |
| 138 | 1.07 | 1.43 | 2.42 | 15.23 | 12.72 | 7.6 |
| 139 | 0.33 | 0.2 | 0.37 | 0.37 | 0.36 | 0.32 |
| 140 | 3.97 | 37.46 | 35.39 | 32.11 | 13.42 | 28.47 |
| 141 | 0.96 | 5.52 | 0.41 | 1.24 | 0.37 | 1.27 |
| 142 | 7.04 | 3.17 | 1.76 | 2.23 | 5.9 | 2.78 |
| 143 | 3.59 | 7.53 | 3 | 13.75 | 18.02 | 37.72 |

TABLE 9B-continued

Training Samples Poor-Outcome patients (2nd Bar of FIG. 7A)

| | | | | | | |
|---|---|---|---|---|---|---|
| 144 | 0.31 | 0.34 | 1.41 | 0.44 | 1.34 | 0.43 |
| 145 | 0.03 | 0.2 | 0.44 | 0.03 | 0.1 | 0.1 |
| 146 | 9.44 | 1.53 | 3.46 | 1.49 | 3.44 | 4.95 |
| 147 | 2.84 | 1.31 | 13.4 | 1.87 | 1.45 | 1.58 |
| 148 | 5.21 | 7.25 | 12.77 | 8.2 | 9.06 | 8.3 |
| 149 | 1.05 | 0.16 | 4.63 | 1.06 | 1.9 | 3.65 |
| 150 | 0.59 | 0.98 | 1.03 | 0.18 | 2.39 | 1.29 |
| 151 | 1.47 | 1.29 | 0.9 | 1.26 | 3.03 | 1.57 |
| 152 | 7.48 | 6.15 | 1.41 | 1.26 | 2.52 | 1.77 |
| 153 | 0.19 | 0.18 | 0.81 | 0.26 | 1.08 | 0.24 |
| 154 | 1.38 | 1.49 | 4.95 | 1.8 | 5.64 | 1.41 |
| 155 | 0.14 | 0.19 | 1.74 | 0.13 | 0.35 | 0.32 |
| 156 | 2.56 | 0.86 | 3.69 | 2.32 | 2.92 | 11.65 |
| 157 | 0.64 | 1.26 | 0.44 | 0.15 | 0.69 | 1.01 |
| 158 | 1.22 | 1.06 | 0.51 | 1.46 | 2.39 | 1.66 |
| 159 | 0.5 | 0.95 | 0.63 | 0.17 | 0.71 | 0.95 |
| 160 | 0.45 | 0.63 | 0.45 | 0.09 | 0.52 | 0.63 |
| 161 | 0.2 | 0.5 | 0.32 | 0.35 | 0.88 | 0.67 |
| 162 | 4.77 | 0.88 | 2.68 | 1.96 | 2.18 | 4.67 |
| 163 | 7.05 | 38.93 | 32.41 | 100 | 100 | 100 |
| 164 | 0.78 | 1.07 | 5.59 | 3.76 | 1.08 | 3.02 |
| 165 | 0.02 | 0.04 | 0.16 | 0.11 | 0.09 | 0.05 |
| 166 | 3.25 | 1.66 | 1.74 | 1.45 | 1.26 | 3.16 |
| 167 | 100 | 100 | 66.02 | 34.82 | 100 | 94.45 |
| 168 | 6.45 | 0.23 | 10.04 | 0.31 | 3.73 | 8.07 |
| 169 | 0.01 | 0.01 | 0.01 | 0.01 | 0.01 | 0.01 |
| 170 | 6.18 | 6.62 | 5.35 | 2.88 | 2.95 | 8.22 |
| 171 | 1.1 | 4 | 4.04 | 2.21 | 1.2 | 1.06 |
| 172 | 1.07 | 2.13 | 0.17 | 0.56 | 0.69 | 0.42 |
| 173 | 0.44 | 1.12 | 3.32 | 2.67 | 1.58 | 1.57 |
| 174 | 5.24 | 4.92 | 1.35 | 1.39 | 6 | 3.85 |
| 175 | 2.59 | 1.76 | 1.08 | 2.88 | 7.75 | 11.54 |
| 176 | 10.58 | 2.7 | 0.67 | 1.47 | 1.02 | 1.04 |
| 177 | 0.43 | 1.46 | 1.11 | 0.42 | 0.75 | 0.58 |
| 178 | 0.17 | 1.48 | 1.96 | 1.33 | 0.77 | 0.6 |
| 179 | 0.36 | 0.29 | 0.31 | 0.44 | 0.57 | 0.7 |
| 180 | 0.05 | 0.19 | 0.3 | 0.32 | 0.15 | 0.08 |
| 181 | 0.28 | 0.51 | 0.52 | 0.29 | 0.28 | 0.21 |
| 182 | 0.51 | 0.42 | 2.4 | 1.02 | 0.79 | 1.43 |
| 183 | 18.11 | 18.2 | 2.99 | 3.2 | 6.14 | 3.41 |
| 184 | 2.29 | 0.69 | 2.58 | 4.4 | 2.67 | 2.94 |
| 185 | 1.07 | 1.98 | 0.59 | 0.25 | 1.22 | 0.91 |
| 186 | 25.58 | 22.13 | 20.11 | 8.38 | 17.18 | 13.66 |
| 187 | 100 | 56.83 | 49.87 | 100 | 65.56 | 98.25 |
| 188 | 0.11 | 1.39 | 1.18 | 0.96 | 0.81 | 0.33 |
| 189 | 0.3 | 0.96 | 0.61 | 0.08 | 0.57 | 0.8 |
| 190 | 1.27 | 1.47 | 3.9 | 7.46 | 1.74 | 1.45 |
| 191 | 2.9 | 0.23 | 0.25 | 0.73 | 2.3 | 5.01 |
| 192 | 0.33 | 0.62 | 0.32 | 0.31 | 0.61 | 0.8 |
| 193 | 1.08 | 0.83 | 3.21 | 1.97 | 3.32 | 3.76 |
| 194 | 0.19 | 0.97 | 0.27 | 0.46 | 2.26 | 2.03 |
| 195 | 1.4 | 0.99 | 1.14 | 1.27 | 1.13 | 1.05 |
| 196 | 0.16 | 0.42 | 1.07 | 0.68 | 0.53 | 0.29 |
| 197 | 6.85 | 1.58 | 3.75 | 3.82 | 1.67 | 2.2 |
| 198 | 4.22 | 2.65 | 0.46 | 0.48 | 1.28 | 0.25 |
| 199 | 0.49 | 0.51 | 1.38 | 3.4 | 1.37 | 2.52 |
| 200 | 0.02 | 0.06 | 0.17 | 0.13 | 0.08 | 0.06 |
| 201 | 1.21 | 3.04 | 0.35 | 0.29 | 0.32 | 0.38 |
| 202 | 4.16 | 0.31 | 4.65 | 0.31 | 2.3 | 8.38 |
| 203 | 3.21 | 6.17 | 1.54 | 0.33 | 2.3 | 1.46 |
| 204 | 1.88 | 1.91 | 1.13 | 0.88 | 2.46 | 2.7 |
| 205 | 1.53 | 1.63 | 0.84 | 1.54 | 1.36 | 1.1 |
| 206 | 1.68 | 0.62 | 0.2 | 0.15 | 0.28 | 0.27 |
| 207 | 11.21 | 2.8 | 2.5 | 1.08 | 3.17 | 1.12 |
| 208 | 13.32 | 3.42 | 6.28 | 2.58 | 5 | 9.49 |
| 209 | 0.32 | 0.47 | 0.17 | 0.08 | 0.31 | 0.24 |
| 210 | 0.75 | 0.63 | 0.99 | 0.84 | 0.72 | 1.32 |
| 211 | 2.25 | 1.33 | 0.66 | 0.58 | 1 | 1.68 |
| 212 | 38.27 | 23.79 | 1.26 | 7.49 | 2.4 | 4.2 |
| 213 | 0.07 | 0.09 | 0.3 | 0.26 | 0.11 | 0.09 |
| 214 | 1.02 | 1.19 | 0.74 | 4.86 | 1.33 | 1.13 |
| 215 | 0.67 | 1.06 | 0.16 | 0.34 | 6.46 | 1.39 |
| 216 | 0.53 | 0.68 | 0.86 | 0.81 | 0.39 | 0.46 |
| 217 | 1.17 | 1.12 | 1.58 | 2 | 1.3 | 1.42 |
| 218 | 1.63 | 0.34 | 0.95 | 1.05 | 1.47 | 0.77 |
| 219 | 1.21 | 1.42 | 0.48 | 0.54 | 1.3 | 2.12 |
| 220 | 0.41 | 1.02 | 0.39 | 0.04 | 0.59 | 0.25 |
| 221 | 0.69 | 0.48 | 1.43 | 0.38 | 0.82 | 0.76 |

TABLE 9B-continued

Training Samples Poor-Outcome patients (2nd Bar of FIG. 7A)

| | | | | | | |
|---|---|---|---|---|---|---|
| 222 | 0.06 | 0.38 | 0.39 | 0.77 | 0.24 | 0.41 |
| 223 | 0.33 | 0.39 | 0.91 | 1.98 | 0.77 | 0.34 |
| 224 | 11.13 | 3.17 | 1.3 | 2.86 | 2.52 | 3.39 |
| 225 | 1.83 | 1.32 | 5.63 | 9.09 | 3.92 | 2.81 |
| 226 | 1.62 | 3.51 | 1.27 | 0.9 | 3.79 | 3.54 |
| 227 | 0.08 | 0.06 | 0.55 | 0.97 | 0.35 | 0.15 |
| 228 | 0.88 | 0.65 | 0.56 | 0.51 | 1.1 | 5.56 |
| 229 | 0.16 | 0.2 | 1.04 | 0.33 | 0.48 | 0.35 |
| 230 | 0.27 | 0.29 | 0.28 | 0.2 | 0.38 | 0.21 |
| 231 | 0.34 | 0.08 | 0.15 | 0.27 | 0.31 | 0.33 |
| 232 | 0.75 | 1.37 | 5.19 | 8.58 | 1.81 | 1.65 |
| 233 | 0.7 | 1.28 | 1.11 | 1.18 | 2.73 | 0.95 |
| 234 | 4.43 | 4.26 | 5.73 | 1.95 | 4.29 | 4.72 |
| 235 | 10.13 | 8.62 | 2.56 | 2.25 | 2.22 | 7.06 |
| 236 | 0.32 | 0.37 | 0.46 | 0.56 | 0.74 | 1.02 |
| 237 | 12.61 | 0.55 | 17.56 | 0.25 | 7.26 | 14.49 |
| 238 | 0.76 | 0.2 | 0.83 | 0.87 | 0.66 | 1.7 |
| 239 | 18.47 | 8.96 | 10.33 | 2.94 | 2.6 | 17.99 |
| 240 | 13.13 | 2.8 | 12.36 | 4.05 | 7.87 | 4.87 |
| 241 | 0.86 | 1.59 | 0.34 | 0.32 | 0.89 | 0.57 |
| 242 | 0.11 | 1.63 | 1.77 | 1.25 | 1.44 | 0.35 |
| 243 | 1.22 | 0.55 | 0.61 | 1.01 | 1.01 | 0.87 |
| 244 | 0.25 | 0.25 | 0.59 | 0.2 | 0.53 | 0.66 |
| 245 | 0.31 | 3.26 | 2.04 | 3.28 | 1.96 | 0.56 |
| 246 | 1.46 | 3.85 | 4.92 | 2.57 | 1.52 | 3.04 |
| 247 | 12.34 | 13.15 | 11.05 | 17.96 | 7.65 | 7.93 |
| 248 | 2.04 | 0.77 | 1.09 | 0.6 | 0.84 | 0.97 |
| 249 | 11.72 | 18.84 | 11.2 | 2.91 | 16.63 | 4.3 |
| 250 | 5.08 | 0.57 | 0.59 | 1.1 | 1.2 | 0.86 |

| Rank | St4_NA_NB273 | St4_NA_NB275 | St4_NA_NB276 | St4_NA_NB283 | St4_NA_NB69 |
|---|---|---|---|---|---|
| 1 | 0.62 | 6.22 | 7.67 | 0.15 | 4.19 |
| 2 | 1.23 | 2.98 | 2.85 | 1.87 | 5.36 |
| 3 | 11.77 | 10.94 | 6.29 | 2.84 | 11.33 |
| 4 | 5.91 | 0.52 | 1.1 | 0.52 | 3.14 |
| 5 | 23.44 | 48.96 | 2.73 | 4.57 | 12.01 |
| 6 | 54.98 | 46.22 | 45.47 | 13.56 | 13.44 |
| 7 | 1.61 | 1.63 | 10.81 | 1.81 | 13.21 |
| 8 | 0.32 | 0.53 | 3.99 | 0.16 | 2.47 |
| 9 | 0.33 | 0.71 | 0.49 | 0.12 | 5.87 |
| 10 | 0.55 | 0.67 | 0.5 | 0.45 | 2.11 |
| 11 | 0.61 | 4.08 | 6.41 | 0.28 | 6.34 |
| 12 | 2.91 | 0.64 | 0.32 | 2.45 | 3.9 |
| 13 | 0.17 | 0.1 | 0.69 | 0.43 | 3.66 |
| 14 | 0.97 | 5.31 | 5.91 | 1.62 | 2.99 |
| 15 | 0.33 | 0.36 | 0.46 | 0.3 | 1.69 |
| 16 | 1.91 | 2.42 | 3.71 | 3.45 | 4.09 |
| 17 | 3.27 | 1.73 | 3.84 | 0.93 | 8.18 |
| 18 | 0.13 | 0.32 | 0.18 | 0.17 | 0.21 |
| 19 | 0.06 | 0.07 | 0.06 | 0.1 | 0.04 |
| 20 | 11.8 | 7.58 | 100 | 9.01 | 13.68 |
| 21 | 29.14 | 20.22 | 10.44 | 3.4 | 1.54 |
| 22 | 0.1 | 0.1 | 0.77 | 0.11 | 0.13 |
| 23 | 0.21 | 0.25 | 0.25 | 0.53 | 2.29 |
| 24 | 1.29 | 19.16 | 31.41 | 1.65 | 1.22 |
| 25 | 3.98 | 2.03 | 6.49 | 10.91 | 18.15 |
| 26 | 31.59 | 30.74 | 35.22 | 10.19 | 8.66 |
| 27 | 0.08 | 0.13 | 0.04 | 0.12 | 0.1 |
| 28 | 3.59 | 1.76 | 8.65 | 3 | 43.65 |
| 29 | 0.22 | 0.16 | 0.14 | 0.24 | 0.32 |
| 30 | 0.57 | 0.05 | 0.09 | 0.27 | 0.4 |
| 31 | 0.07 | 4.87 | 10.64 | 1.1 | 8.58 |
| 32 | 12.19 | 61.16 | 77.52 | 4.9 | 0.89 |
| 33 | 8.07 | 4.54 | 7.47 | 1.5 | 4 |
| 34 | 0.09 | 0.09 | 0.01 | 0.1 | 0.11 |
| 35 | 20.94 | 10.81 | 11.63 | 39.03 | 17.64 |
| 36 | 1.96 | 0.92 | 1.87 | 1.56 | 8.37 |
| 37 | 0.83 | 1.02 | 0.59 | 0.75 | 1.93 |
| 38 | 0.44 | 3.42 | 2.97 | 0.05 | 1 |
| 39 | 15.92 | 6.57 | 1.09 | 4.05 | 2.02 |
| 40 | 4.63 | 11.09 | 34.95 | 2.26 | 3.76 |
| 41 | 5.94 | 6.47 | 3.18 | 1.94 | 3.22 |
| 42 | 1.5 | 8.28 | 8.71 | 0.95 | 1.78 |
| 43 | 3.18 | 3.85 | 0.36 | 0.49 | 0.86 |
| 44 | 0.73 | 3.08 | 0.73 | 0.69 | 1.48 |
| 45 | 0.14 | 0.3 | 0.2 | 0.24 | 0.92 |
| 46 | 1.06 | 0.96 | 1.27 | 1.28 | 4.01 |

TABLE 9B-continued

Training Samples Poor-Outcome patients (2nd Bar of FIG. 7A)

| | | | | | |
|---|---|---|---|---|---|
| 47 | 0.49 | 0.05 | 0.13 | 0.28 | 0.41 |
| 48 | 0.71 | 0.03 | 0.06 | 0.16 | 0.67 |
| 49 | 0.49 | 0.13 | 0.23 | 0.14 | 0.54 |
| 50 | 0.24 | 2.28 | 3.54 | 0.22 | 0.29 |
| 51 | 2.97 | 7.91 | 0.91 | 1.34 | 0.4 |
| 52 | 10.83 | 2.91 | 1.67 | 0.73 | 0.34 |
| 53 | 1.1 | 4.76 | 2.52 | 7.1 | 3.75 |
| 54 | 1.14 | 3.57 | 3.38 | 0.87 | 0.66 |
| 55 | 1.88 | 0.59 | 0.61 | 0.29 | 1.73 |
| 56 | 0.78 | 2.94 | 0.65 | 0.92 | 1.78 |
| 57 | 2.56 | 0.86 | 0.5 | 4.11 | 7.13 |
| 58 | 10.59 | 12.67 | 8.17 | 7.07 | 20.06 |
| 59 | 0.12 | 0.11 | 0.48 | 0.24 | 1.94 |
| 60 | 49.72 | 32.42 | 18.78 | 26.55 | 28.37 |
| 61 | 46.84 | 33.99 | 13.79 | 28.99 | 42.97 |
| 62 | 1.19 | 0.24 | 0.89 | 0.42 | 1.56 |
| 63 | 3.33 | 1.89 | 3.38 | 3.89 | 4.39 |
| 64 | 3.21 | 1.42 | 1.17 | 1.61 | 0.9 |
| 65 | 2.81 | 11.47 | 8.11 | 1.55 | 4.68 |
| 66 | 0.85 | 1.78 | 2.69 | 1.53 | 0.44 |
| 67 | 0.94 | 3.76 | 1.04 | 3.75 | 5.82 |
| 68 | 0.46 | 0.6 | 0.5 | 0.89 | 0.86 |
| 69 | 1.64 | 100 | 34.92 | 34.13 | 15.91 |
| 70 | 0.02 | 0.02 | 0.03 | 0.03 | 0.02 |
| 71 | 1.89 | 0.88 | 1.35 | 1.94 | 2.5 |
| 72 | 3.42 | 11.37 | 7.93 | 8.79 | 7.5 |
| 73 | 44.87 | 100 | 100 | 6.1 | 5.85 |
| 74 | 0.36 | 0.37 | 0.56 | 0.92 | 1.51 |
| 75 | 0.76 | 0.48 | 0.98 | 1.09 | 1.34 |
| 76 | 3.3 | 2.1 | 8.88 | 3.36 | 4.01 |
| 77 | 2.35 | 5.75 | 9.61 | 2.88 | 5.42 |
| 78 | 15.57 | 10.45 | 11.32 | 38.41 | 20.2 |
| 79 | 0.84 | 0.72 | 2.66 | 1.27 | 2.42 |
| 80 | 2.52 | 6.28 | 10.74 | 0.53 | 18.5 |
| 81 | 19.34 | 33.27 | 15.01 | 28.01 | 8.3 |
| 82 | 0.19 | 0.28 | 0.49 | 0.22 | 3.34 |
| 83 | 0.51 | 0.83 | 0.01 | 0.72 | 0.88 |
| 84 | 0.61 | 0.57 | 0.04 | 0.41 | 0.55 |
| 85 | 0.46 | 2.14 | 2.32 | 0.2 | 0.77 |
| 86 | 0.33 | 0.29 | 0.09 | 0.76 | 0.55 |
| 87 | 0.38 | 0.45 | 0.61 | 0.54 | 0.54 |
| 88 | 0.94 | 1.41 | 1.33 | 1.12 | 2.4 |
| 89 | 0.1 | 0.16 | 0.01 | 0.18 | 0.07 |
| 90 | 0.22 | 1.11 | 0.19 | 0.21 | 0.14 |
| 91 | 1.44 | 6.08 | 4.02 | 0.69 | 1.13 |
| 92 | 0.16 | 2.32 | 0.82 | 0.84 | 0.07 |
| 93 | 1.22 | 0.16 | 0.08 | 0.15 | 1.25 |
| 94 | 0.29 | 1.28 | 2.35 | 1.06 | 0.89 |
| 95 | 2.22 | 2.1 | 2.31 | 4.08 | 2.53 |
| 96 | 0.17 | 0.04 | 0.02 | 0.06 | 0.05 |
| 97 | 0.48 | 0.76 | 0.76 | 1.13 | 1.63 |
| 98 | 0.99 | 0.67 | 1.5 | 1 | 0.94 |
| 99 | 0.39 | 0.05 | 0.1 | 0.18 | 0.29 |
| 100 | 4.36 | 5.64 | 12.73 | 6.34 | 7.1 |
| 101 | 2.19 | 1.94 | 0.03 | 9.8 | 11.99 |
| 102 | 1.03 | 2.54 | 0.74 | 0.96 | 1.52 |
| 103 | 1.43 | 0.46 | 0.52 | 0.43 | 1.04 |
| 104 | 1.24 | 1.22 | 0.98 | 1.67 | 1.15 |
| 105 | 1.41 | 0.34 | 0.34 | 1.64 | 2.2 |
| 106 | 3.12 | 3.53 | 15.78 | 2.63 | 3.68 |
| 107 | 0.56 | 0.29 | 0.04 | 0.57 | 0.72 |
| 108 | 4.54 | 14.61 | 10.81 | 10.15 | 8.77 |
| 109 | 0.36 | 0.49 | 1.64 | 0.5 | 0.43 |
| 110 | 0.39 | 0.77 | 0.5 | 1.03 | 2.37 |
| 111 | 100 | 84.82 | 96.39 | 100 | 98.44 |
| 112 | 1.1 | 1.05 | 1.54 | 1.3 | 2.89 |
| 113 | 2.12 | 3.26 | 1.52 | 1.98 | 4.29 |
| 114 | 4.74 | 2.57 | 2.14 | 1.38 | 4.22 |
| 115 | 2.45 | 0.81 | 1.23 | 1.13 | 1.29 |
| 116 | 0.17 | 0.39 | 0.01 | 0.58 | 0.5 |
| 117 | 0.33 | 0.04 | 0.08 | 0.17 | 0.21 |
| 118 | 0.66 | 0.4 | 1.38 | 1.4 | 8.04 |
| 119 | 5.41 | 1.3 | 1.92 | 2.07 | 6.13 |
| 120 | 0.68 | 2.74 | 5.51 | 1.11 | 0.83 |
| 121 | 22.94 | 8.93 | 32.76 | 17.59 | 9.03 |
| 122 | 1.7 | 2.31 | 3.59 | 1.83 | 3.63 |
| 123 | 0.83 | 0.45 | 1.35 | 0.82 | 3.41 |
| 124 | 0.65 | 0.4 | 0.6 | 1.76 | 1.82 |

TABLE 9B-continued

Training Samples Poor-Outcome patients (2nd Bar of FIG. 7A)

| | | | | | |
|---|---|---|---|---|---|
| 125 | 23.4 | 1.16 | 3.57 | 66.38 | 70.86 |
| 126 | 8.61 | 33.23 | 4.93 | 2.79 | 1.8 |
| 127 | 0.36 | 0.73 | 0.01 | 0.98 | 2.41 |
| 128 | 0.38 | 0.53 | 0.36 | 0.68 | 0.86 |
| 129 | 0.66 | 1.21 | 1.54 | 1.54 | 1.49 |
| 130 | 7.8 | 2.58 | 9.23 | 3.86 | 19.17 |
| 131 | 1.3 | 1.44 | 1.93 | 3.99 | 1.66 |
| 132 | 9.82 | 2.46 | 3.31 | 1.3 | 3.75 |
| 133 | 1.06 | 0.81 | 2.31 | 0.8 | 1.3 |
| 134 | 0.53 | 0.66 | 0.83 | 0.97 | 1.28 |
| 135 | 0.36 | 0.54 | 0.5 | 0.29 | 2.97 |
| 136 | 0.72 | 0.88 | 0.43 | 0.55 | 0.33 |
| 137 | 0.08 | 0.35 | 0.04 | 0.47 | 0.06 |
| 138 | 14.03 | 14.25 | 10.27 | 3.86 | 6.3 |
| 139 | 0.29 | 0.21 | 0.39 | 0.24 | 0.75 |
| 140 | 19.73 | 15.37 | 42.38 | 12.16 | 24.89 |
| 141 | 1.11 | 0.33 | 1.05 | 0.48 | 1.53 |
| 142 | 2.35 | 8.08 | 4.12 | 3.1 | 1.74 |
| 143 | 19.81 | 25.42 | 34.01 | 3.5 | 8.18 |
| 144 | 0.47 | 1 | 0.01 | 1.66 | 0.26 |
| 145 | 0.02 | 0.08 | 0.07 | 1.59 | 0.05 |
| 146 | 1.2 | 2.94 | 4.06 | 7.52 | 12.11 |
| 147 | 2.36 | 1.94 | 2.84 | 2.02 | 1.3 |
| 148 | 10 | 9.07 | 6.28 | 2.93 | 11.84 |
| 149 | 1.2 | 2.26 | 2.76 | 1.44 | 7.54 |
| 150 | 0.25 | 3.24 | 1.34 | 1.68 | 1.15 |
| 151 | 1.1 | 2.78 | 5.86 | 1.34 | 4.8 |
| 152 | 1.31 | 3.11 | 1.29 | 1.59 | 5.55 |
| 153 | 0.35 | 0.94 | 0.15 | 1.88 | 1.02 |
| 154 | 2.41 | 3.11 | 1.03 | 11.81 | 1.76 |
| 155 | 0.07 | 0.2 | 0.19 | 3.68 | 0.23 |
| 156 | 1.84 | 1.48 | 11.82 | 0.58 | 0.76 |
| 157 | 0.15 | 1.14 | 0.92 | 1.23 | 0.55 |
| 158 | 1.32 | 3.32 | 1.34 | 6.14 | 0.58 |
| 159 | 0.2 | 0.92 | 0.98 | 0.7 | 0.53 |
| 160 | 0.13 | 0.93 | 1.17 | 0.41 | 0.36 |
| 161 | 0.5 | 0.73 | 0.34 | 0.47 | 1.06 |
| 162 | 1.7 | 1.11 | 7.33 | 4.66 | 2.67 |
| 163 | 100 | 94.42 | 100 | 89.59 | 26.53 |
| 164 | 2.72 | 0.77 | 3.79 | 1.97 | 2.7 |
| 165 | 0.14 | 0.1 | 0.05 | 0.05 | 0.12 |
| 166 | 1.48 | 1.7 | 2.58 | 1.96 | 6.54 |
| 167 | 97.72 | 100 | 100 | 100 | 100 |
| 168 | 0.34 | 4.11 | 5.26 | 0.8 | 4.17 |
| 169 | 0.01 | 0.01 | 0.01 | 0.01 | 0.01 |
| 170 | 2.13 | 3.29 | 5.22 | 9.01 | 26.44 |
| 171 | 4.79 | 0.86 | 0.85 | 5.66 | 1.79 |
| 172 | 1.16 | 0.44 | 0.32 | 0.56 | 1.16 |
| 173 | 2.2 | 1.76 | 1 | 2.7 | 3.39 |
| 174 | 1.57 | 10.58 | 3.53 | 1.55 | 3.04 |
| 175 | 2.34 | 8.84 | 8.24 | 1.15 | 1.59 |
| 176 | 0.75 | 0.72 | 2.28 | 0.9 | 23.28 |
| 177 | 0.39 | 0.9 | 0.51 | 0.57 | 0.4 |
| 178 | 1.48 | 0.88 | 0.33 | 1.78 | 2.73 |
| 179 | 0.5 | 0.53 | 0.57 | 0.39 | 0.17 |
| 180 | 0.43 | 0.15 | 0.07 | 0.23 | 0.37 |
| 181 | 0.39 | 0.2 | 0.13 | 0.47 | 1.35 |
| 182 | 0.99 | 0.5 | 0.87 | 2.08 | 4.47 |
| 183 | 3.11 | 8.62 | 3.76 | 1.74 | 6.73 |
| 184 | 5.6 | 2.33 | 2.91 | 1.78 | 1.88 |
| 185 | 0.23 | 1.24 | 1 | 1.12 | 0.72 |
| 186 | 7.28 | 19.43 | 22.87 | 19.5 | 24.09 |
| 187 | 100 | 63.06 | 100 | 89.25 | 100 |
| 188 | 1.11 | 0.46 | 0.14 | 0.98 | 2.11 |
| 189 | 0.08 | 0.77 | 1.25 | 0.83 | 0.61 |
| 190 | 7.22 | 1.32 | 0.75 | 1.96 | 4.15 |
| 191 | 0.91 | 2.58 | 6.19 | 0.16 | 0.42 |
| 192 | 0.43 | 0.82 | 0.51 | 0.5 | 0.93 |
| 193 | 2.01 | 2.7 | 3.09 | 2.35 | 11.66 |
| 194 | 0.55 | 2.94 | 18.09 | 0.2 | 2.04 |
| 195 | 1.17 | 1.25 | 1.2 | 1.4 | 2.78 |
| 196 | 1.21 | 0.33 | 0.21 | 0.34 | 0.54 |
| 197 | 4.13 | 1.78 | 2.33 | 9.27 | 20.98 |
| 198 | 0.38 | 1.23 | 0.1 | 1.04 | 1.03 |
| 199 | 4.16 | 1.88 | 2.57 | 4.37 | 1.27 |
| 200 | 0.14 | 0.09 | 0.04 | 0.07 | 0.13 |
| 201 | 0.29 | 0.29 | 0.28 | 0.15 | 0.27 |
| 202 | 0.39 | 2.13 | 4.21 | 0.72 | 3.65 |

TABLE 9B-continued

Training Samples Poor-Outcome patients (2nd Bar of FIG. 7A)

| | | | | | |
|---|---|---|---|---|---|
| 203 | 0.37 | 3.22 | 1.66 | 1.59 | 5.83 |
| 204 | 1 | 3.13 | 1.99 | 1.14 | 1.17 |
| 205 | 1.97 | 1.79 | 1.34 | 1.63 | 0.73 |
| 206 | 0.13 | 0.29 | 0.26 | 1.25 | 1.74 |
| 207 | 1.31 | 3.78 | 0.9 | 0.61 | 0.94 |
| 208 | 2.92 | 4.01 | 10.85 | 4.55 | 5.59 |
| 209 | 0.11 | 0.55 | 0.31 | 0.27 | 0.22 |
| 210 | 0.83 | 0.65 | 1.19 | 1.04 | 1.25 |
| 211 | 0.47 | 1.02 | 2.28 | 1.82 | 0.62 |
| 212 | 4.88 | 0.94 | 1.8 | 15.7 | 13.17 |
| 213 | 0.21 | 0.09 | 0.09 | 0.07 | 0.15 |
| 214 | 3.57 | 1.4 | 1.31 | 0.87 | 1.59 |
| 215 | 1.08 | 3.03 | 2.1 | 0.16 | 0.13 |
| 216 | 0.8 | 0.35 | 0.33 | 0.57 | 0.8 |
| 217 | 2.84 | 1.13 | 1.32 | 2.03 | 4.41 |
| 218 | 1.61 | 1.99 | 0.58 | 0.97 | 0.6 |
| 219 | 0.54 | 1.65 | 2.26 | 0.22 | 2.33 |
| 220 | 0.03 | 0.62 | 0.4 | 0.83 | 0.27 |
| 221 | 0.4 | 0.43 | 0.66 | 0.62 | 0.66 |
| 222 | 0.92 | 0.24 | 0.28 | 0.26 | 0.47 |
| 223 | 1.92 | 0.67 | 0.27 | 0.62 | 0.82 |
| 224 | 3.23 | 2.43 | 2.95 | 1.71 | 1.23 |
| 225 | 11.77 | 4.63 | 2.47 | 3.36 | 0.76 |
| 226 | 1.12 | 5.11 | 2.28 | 0.59 | 0.87 |
| 227 | 1.04 | 0.25 | 0.27 | 0.22 | 0.17 |
| 228 | 0.59 | 0.4 | 8.44 | 0.54 | 0.5 |
| 229 | 0.46 | 0.56 | 0.33 | 0.23 | 2.35 |
| 230 | 0.18 | 0.33 | 0.28 | 0.33 | 0.15 |
| 231 | 0.39 | 0.31 | 0.34 | 0.19 | 0.07 |
| 232 | 4.96 | 1.01 | 1.17 | 3.35 | 2.78 |
| 233 | 1.15 | 0.87 | 1.01 | 2.03 | 2.22 |
| 234 | 2.89 | 6.12 | 6.32 | 2.83 | 2.61 |
| 235 | 2.32 | 2.26 | 7.48 | 1.29 | 2.55 |
| 236 | 0.67 | 0.59 | 0.65 | 0.99 | 1.32 |
| 237 | 0.29 | 3.39 | 17.05 | 1.4 | 4.68 |
| 238 | 1.14 | 0.7 | 1.28 | 1.1 | 0.29 |
| 239 | 4.19 | 3.27 | 11.33 | 7.34 | 44.07 |
| 240 | 5.97 | 9.55 | 3.58 | 6.83 | 20.32 |
| 241 | 0.24 | 0.69 | 0.73 | 0.78 | 1.09 |
| 242 | 1.75 | 1.35 | 0.26 | 1.21 | 1.84 |
| 243 | 1.32 | 0.96 | 1.11 | 3.49 | 6.64 |
| 244 | 0.25 | 0.46 | 0.56 | 0.12 | 1.16 |
| 245 | 3.97 | 2.5 | 0.46 | 1 | 1.33 |
| 246 | 3.17 | 1.36 | 3.29 | 1.13 | 2.81 |
| 247 | 19.12 | 8.17 | 8.6 | 9.17 | 13.71 |
| 248 | 0.6 | 0.82 | 0.67 | 1.8 | 1.98 |
| 249 | 5.04 | 34.59 | 8.45 | 13.74 | 6.92 |
| 250 | 0.82 | 0.83 | 0.24 | 1.27 | 2.16 |

TABLE 9C

Testing: Good (G) and Poor (P) (3rd and 4th Bars of FIG. 7A)

| Rank | Gene | St1_NA_NB221 (G) | St1_NA_NB238 (G) | St1_NA_NB33 (G) | St1_NA_NB34 (G) | St1_NA_NB9 (G) |
|---|---|---|---|---|---|---|
| 1 | DLK1 | 0.09 | 0.29 | 0.08 | 0.56 | 0.03 |
| 2 | est | 0.27 | 0.24 | 0.38 | 0.73 | 0.45 |
| 3 | PRSS3 | 1.21 | 1.73 | 2.19 | 4.74 | 1.91 |
| 4 | ARHI | 14.49 | 18.97 | 5.25 | 3.98 | 5.5 |
| 5 | ARC | 5.53 | 1.88 | 1.38 | 1.71 | 2.19 |
| 6 | SLIT3 | 16.52 | 9.18 | 10.57 | 18.44 | 10.89 |
| 7 | CNR1 | 14.38 | 15.81 | 4.38 | 2.29 | 16.34 |
| 8 | est | 0.23 | 0.18 | 0.24 | 0.66 | 0.11 |
| 9 | est | 3.03 | 1.93 | 1.67 | 1.43 | 1.42 |
| 10 | FLJ25461 | 1.27 | 0.67 | 1.77 | 1.84 | 1.03 |
| 11 | est | 0.24 | 0.34 | 0.28 | 0.63 | 0.35 |
| 12 | CD44 | 2.82 | 3.47 | 4.66 | 3.47 | 3.27 |
| 13 | est | 0.69 | 1.26 | 1.17 | 0.68 | 1.04 |
| 14 | ROBO2 | 8.69 | 10.63 | 7.12 | 2.54 | 5.93 |
| 15 | BTBD3 | 1.94 | 2.73 | 1.51 | 0.82 | 2.75 |
| 16 | MYCN | 5 | 4.98 | 2.66 | 6.99 | 4.22 |
| 17 | est | 20.9 | 21.61 | 3.33 | 4.26 | 22.75 |
| 18 | JPH1 | 0.02 | 0.03 | 0.06 | 0.04 | 0.04 |
| 19 | KLRC3 | 0.07 | 0.14 | 0.24 | 0.17 | 0.2 |

TABLE 9C-continued

| | Testing: Good (G) and Poor (P) (3rd and 4th Bars of FIG. 7A) | | | | | |
|---|---|---|---|---|---|---|
| 20 | est | 4.31 | 7.39 | 1.06 | 2.41 | 1.99 |
| 21 | RET | 5.88 | 2.4 | 2.65 | 2.93 | 1.63 |
| 22 | CRABP1 | 0.29 | 0.11 | 0.17 | 0.32 | 0.09 |
| 23 | ECEL1 | 4.95 | 3.32 | 2.29 | 2.39 | 2.04 |
| 24 | LOC283120 | 1.7 | 0.7 | 1.09 | 1.04 | 1.86 |
| 25 | HMGA2 | 40.25 | 8.37 | 11.35 | 17.6 | 11.27 |
| 26 | SYNPO2 | 4.04 | 11.3 | 3.67 | 5.8 | 9.65 |
| 27 | LOC163782 | 0.23 | 0.13 | 0.29 | 0.23 | 0.12 |
| 28 | VSNL1 | 22.01 | 19.81 | 2.47 | 5.04 | 10.94 |
| 29 | HS3ST4 | 0.29 | 0.15 | 0.67 | 0.76 | 0.14 |
| 30 | AKR1C1 | 0.45 | 0.69 | 0.33 | 0.26 | 0.29 |
| 31 | est | 0.14 | 0.05 | 7.55 | 0.05 | 0.1 |
| 32 | GPR22 | 2.59 | 6.85 | 7.09 | 33.62 | 5.57 |
| 33 | est | 2.01 | 1.05 | 1.35 | 2.29 | 2.42 |
| 34 | est | 0.14 | 0.5 | 0.96 | 0.39 | 0.36 |
| 35 | CCNA1 | 7.84 | 4.01 | 2.1 | 1.64 | 5.94 |
| 36 | PKIB | 1.38 | 6.18 | 9.16 | 17.61 | 9.03 |
| 37 | est | 1.17 | 0.8 | 1.2 | 1.57 | 0.85 |
| 38 | GAL | 0.02 | 0.09 | 0.11 | 0.29 | 0.32 |
| 39 | est | 0.19 | 0.22 | 0.34 | 1.04 | 0.41 |
| 40 | LOC221303 | 2.27 | 3.55 | 1.84 | 5.93 | 2.01 |
| 41 | est | 1.79 | 2.11 | 1.16 | 3.09 | 1.86 |
| 42 | est | 0.99 | 2.93 | 1.14 | 3.41 | 1.89 |
| 43 | BMP7 | 0.21 | 0.16 | 5.05 | 4.62 | 1.07 |
| 44 | SLC30A3 | 0.79 | 0.5 | 0.72 | 0.96 | 1.2 |
| 45 | FLJ10539 | 0.32 | 0.9 | 1.35 | 0.84 | 1.03 |
| 46 | AMIGO2 | 6.06 | 14.48 | 1.81 | 2.2 | 6.4 |
| 47 | AKR1C2 | 0.51 | 0.65 | 0.46 | 0.35 | 0.42 |
| 48 | MGP | 0.04 | 0.09 | 0.05 | 0.08 | 0.13 |
| 49 | PCSK1 | 0.95 | 0.74 | 0.55 | 0.62 | 0.48 |
| 50 | HK2 | 0.48 | 0.25 | 0.19 | 0.32 | 0.22 |
| 51 | est | 0.53 | 0.43 | 0.68 | 0.66 | 0.47 |
| 52 | est | 0.23 | 0.33 | 0.7 | 0.62 | 0.37 |
| 53 | IL7 | 3.57 | 10.87 | 10.08 | 7.91 | 14.22 |
| 54 | PRSS12 | 0.88 | 1.47 | 0.99 | 1.37 | 0.85 |
| 55 | GABARAPL1 | 1.15 | 1.83 | 0.75 | 1.12 | 1.02 |
| 56 | DEFB129 | 0.64 | 0.64 | 0.78 | 0.84 | 1.05 |
| 57 | NAV3 | 7.82 | 8.78 | 5.48 | 5.16 | 5.22 |
| 58 | RAB3B | 9.61 | 16.05 | 7.26 | 7.7 | 9.24 |
| 59 | KRT6B | 2.65 | 2.88 | 4.96 | 3.37 | 5.23 |
| 60 | BEX1 | 26.39 | 23.35 | 9.78 | 16.38 | 11.86 |
| 61 | est | 33.68 | 24.94 | 9.4 | 15.39 | 11.82 |
| 62 | est | 3.55 | 2.55 | 5.21 | 1.65 | 1.89 |
| 63 | SCYL1 | 5.21 | 6.88 | 5.26 | 4.82 | 3.27 |
| 64 | est | 38.31 | 21.83 | 7.24 | 5.15 | 2.86 |
| 65 | RYR2 | 12.7 | 15.14 | 26.56 | 16.27 | 9.44 |
| 66 | LRBA | 0.8 | 0.85 | 0.54 | 0.67 | 0.52 |
| 67 | CSPG3 | 3.27 | 0.73 | 0.45 | 0.69 | 0.7 |
| 68 | est | 2.61 | 5.37 | 1.15 | 1.65 | 1.98 |
| 69 | MMP12 | 3.49 | 10.92 | 3.19 | 5.15 | 2.5 |
| 70 | CHRNA1 | 0.13 | 0.03 | 0.06 | 0.03 | 0.03 |
| 71 | est | 4.91 | 2.56 | 2.13 | 1.92 | 1.75 |
| 72 | est | 76.94 | 58.08 | 20.79 | 10.75 | 30.61 |
| 73 | HNRPH1 | 2.52 | 3.96 | 2.11 | 28.27 | 100 |
| 74 | LOC113251 | 2.84 | 3.35 | 3.11 | 1.55 | 1.85 |
| 75 | est | 5.2 | 2.38 | 2.05 | 1.55 | 1.66 |
| 76 | PAG | 3.93 | 5.58 | 4.61 | 3.91 | 3.7 |
| 77 | PROK2 | 14.79 | 10.65 | 8.93 | 3.7 | 9.07 |
| 78 | HS6ST1 | 9.13 | 3.76 | 2.2 | 2.36 | 6.37 |
| 79 | est | 8.87 | 9.69 | 12.05 | 9.59 | 8.8 |
| 80 | PCDH9 | 15.3 | 24.39 | 9.19 | 15.45 | 7.67 |
| 81 | est | 9.85 | 21.46 | 13.88 | 15.19 | 12.21 |
| 82 | est | 2.49 | 1.69 | 0.25 | 0.27 | 0.24 |
| 83 | GLDC | 0.51 | 0.46 | 0.4 | 0.45 | 0.31 |
| 84 | ADRB2 | 1.33 | 3.79 | 1.16 | 2.02 | 1.25 |
| 85 | ICSBP1 | 0.07 | 0.14 | 0.26 | 0.34 | 0.42 |
| 86 | CD48 | 0.1 | 0.97 | 0.68 | 0.43 | 1.04 |
| 87 | est | 0.57 | 1.05 | 1.58 | 1.19 | 1.62 |
| 88 | DYRK1B | 0.52 | 0.53 | 0.59 | 0.63 | 0.61 |
| 89 | KLRC1 | 0.09 | 0.2 | 0.27 | 0.22 | 0.37 |
| 90 | est | 0.15 | 0.21 | 0.15 | 0.13 | 0.17 |
| 91 | est | 1.97 | 0.58 | 1.3 | 1.28 | 0.54 |
| 92 | est | 0.04 | 0.31 | 0.12 | 0.42 | 0.06 |
| 93 | MOXD1 | 0.1 | 0.15 | 0.18 | 0.24 | 0.26 |
| 94 | est | 0.49 | 0.26 | 0.48 | 0.36 | 0.43 |
| 95 | est | 7.25 | 9.93 | 5.4 | 6.78 | 5.35 |
| 96 | GAS1 | 0.07 | 0.06 | 0.06 | 0.06 | 0.2 |
| 97 | COL9A2 | 0.16 | 1.9 | 0.47 | 0.41 | 0.49 |

TABLE 9C-continued

Testing: Good (G) and Poor (P) (3rd and 4th Bars of FIG. 7A)

| | | | | | | |
|---|---|---|---|---|---|---|
| 98 | est | 1.61 | 2.27 | 1.31 | 1.55 | 1.7 |
| 99 | DRPLA | 0.43 | 0.58 | 0.34 | 0.27 | 0.25 |
| 100 | est | 13.38 | 23.5 | 21.1 | 15.4 | 16.16 |
| 101 | REPRIMO | 5.31 | 27.34 | 3.89 | 7.35 | 12.92 |
| 102 | CACNA2D2 | 0.71 | 0.73 | 0.86 | 0.98 | 0.86 |
| 103 | NEBL | 1.07 | 1.24 | 1.23 | 1.01 | 1.02 |
| 104 | est | 1.66 | 3.44 | 1.47 | 3.36 | 1.46 |
| 105 | HLA-DQA1 | 0.41 | 4.98 | 3.89 | 1.3 | 4.22 |
| 106 | EDG3 | 4.94 | 2.93 | 2.92 | 3.08 | 0.87 |
| 107 | CPVL | 0.21 | 0.5 | 0.63 | 0.36 | 0.87 |
| 108 | FLJ32884 | 18.74 | 7.74 | 13.71 | 8.68 | 17.39 |
| 109 | LCP1 | 0.22 | 1.02 | 0.51 | 0.37 | 0.85 |
| 110 | est | 4.14 | 3.21 | 3.81 | 2.84 | 5.83 |
| 111 | est | 49.69 | 91.15 | 9.62 | 43.63 | 38.78 |
| 112 | est | 3.21 | 5.85 | 9.64 | 8.22 | 6.68 |
| 113 | est | 2.42 | 2.9 | 2.06 | 2.28 | 2.95 |
| 114 | DKFZP564C152 | 1.78 | 0.85 | 1.05 | 1.33 | 1.57 |
| 115 | DMN | 1.68 | 2.27 | 1.2 | 1.75 | 0.64 |
| 116 | GABRA5 | 0.25 | 0.17 | 0.48 | 0.27 | 0.18 |
| 117 | AKR1C3 | 0.33 | 0.3 | 0.3 | 0.22 | 0.21 |
| 118 | LOC168850 | 4.59 | 6.27 | 9.21 | 5.86 | 8.02 |
| 119 | est | 8.39 | 8.79 | 2.57 | 3.2 | 4.3 |
| 120 | KCNQ2 | 0.8 | 0.5 | 1.1 | 0.93 | 0.59 |
| 121 | NME5 | 10.83 | 10.82 | 1.95 | 3.54 | 4.35 |
| 122 | est | 2.04 | 2.12 | 4.28 | 2.96 | 6.92 |
| 123 | PBX1 | 4.71 | 2.81 | 2.46 | 1.65 | 1.3 |
| 124 | CNTNAP2 | 1.87 | 1.02 | 3.52 | 1.41 | 2.25 |
| 125 | est | 12.91 | 15.7 | 80.61 | 95.55 | 35.71 |
| 126 | SPON1 | 2.96 | 0.89 | 1.27 | 1.69 | 4.84 |
| 127 | CDH8 | 4.02 | 2.91 | 3.49 | 3 | 5.84 |
| 128 | PRKCB1 | 0.33 | 0.48 | 1.14 | 1.81 | 0.51 |
| 129 | SLC21A11 | 2.3 | 3.37 | 2.56 | 2.31 | 2.99 |
| 130 | MAP4 | 17.95 | 25.02 | 9.37 | 17.93 | 16.31 |
| 131 | est | 4.17 | 4.98 | 6.8 | 3.86 | 3.36 |
| 132 | SCN7A | 6.73 | 10.24 | 1.26 | 1.81 | 5.3 |
| 133 | est | 8.75 | 7.91 | 1.41 | 1.24 | 7.58 |
| 134 | est | 1.62 | 1.38 | 1.38 | 1.61 | 1.93 |
| 135 | est | 2.49 | 1.27 | 1.32 | 1.12 | 1.05 |
| 136 | est | 0.46 | 0.52 | 1.11 | 1.45 | 0.55 |
| 137 | CDW52 | 0.05 | 0.22 | 0.3 | 0.2 | 0.28 |
| 138 | ABCB1 | 2.14 | 2.15 | 1.9 | 6.81 | 3.48 |
| 139 | est | 1.79 | 2.3 | 0.77 | 0.52 | 0.39 |
| 140 | OSF-2 | 4.6 | 10.19 | 3.87 | 10.22 | 6.13 |
| 141 | NRXN1 | 3.36 | 2.43 | 3.9 | 1.25 | 2.08 |
| 142 | ADAM22 | 2.16 | 1.84 | 3.44 | 3.15 | 2.47 |
| 143 | est | 7.71 | 6.98 | 3.9 | 8.83 | 4.38 |
| 144 | TRGV9 | 0.31 | 1.4 | 0.94 | 0.74 | 2.03 |
| 145 | est | 0.03 | 0.06 | 0.13 | 0.16 | 0.37 |
| 146 | PTPRD | 10.93 | 10.23 | 9.14 | 4.72 | 5.1 |
| 147 | est | 0.84 | 0.63 | 0.61 | 0.64 | 0.64 |
| 148 | HS3ST2 | 3.69 | 3.74 | 1.1 | 1.83 | 1.46 |
| 149 | FGF13 | 2.78 | 3.82 | 2.94 | 3.25 | 3.33 |
| 150 | MKI67 | 0.43 | 0.33 | 0.59 | 0.23 | 0.49 |
| 151 | KIF12 | 1.85 | 1.58 | 1.5 | 1.41 | 1.89 |
| 152 | est | 1.18 | 1.39 | 1.15 | 1.01 | 1.05 |
| 153 | est | 0.29 | 0.9 | 0.96 | 0.68 | 1.44 |
| 154 | est | 1.92 | 7.25 | 5.36 | 4.44 | 12.54 |
| 155 | est | 0.19 | 0.13 | 0.35 | 0.55 | 0.82 |
| 156 | est | 3.78 | 10.54 | 1.37 | 7.58 | 1.92 |
| 157 | KLIP1 | 0.47 | 0.14 | 0.49 | 0.17 | 0.47 |
| 158 | est | 0.59 | 0.82 | 0.66 | 0.93 | 0.66 |
| 159 | LOC157570 | 0.28 | 0.14 | 0.49 | 0.24 | 0.43 |
| 160 | MAD2L1 | 0.21 | 0.16 | 0.18 | 0.09 | 0.22 |
| 161 | est | 0.81 | 0.44 | 0.69 | 0.58 | 0.58 |
| 162 | est | 6.38 | 7.28 | 5.92 | 6.63 | 5.2 |
| 163 | RGS5 | 53.87 | 43.46 | 33.73 | 65.93 | 56.46 |
| 164 | ATP2B4 | 7.69 | 5.48 | 2.13 | 2.71 | 2.98 |
| 165 | HMGCL | 0.05 | 0.1 | 0.07 | 0.08 | 0.12 |
| 166 | ODZ3 | 2.31 | 2.77 | 3.48 | 3.79 | 3.13 |
| 167 | CHGA | 100 | 100 | 34.9 | 79.57 | 97.29 |
| 168 | MGC33510 | 0.31 | 0.22 | 5.3 | 0.25 | 0.2 |
| 169 | GAGE5 | 0.01 | 0.01 | 0.01 | 0.01 | 0.01 |
| 170 | SARDH | 26.07 | 27.53 | 21.62 | 13.27 | 17.8 |
| 171 | est | 0.51 | 2.8 | 1.88 | 2.61 | 7.72 |
| 172 | DAT1 | 0.55 | 0.12 | 0.67 | 0.26 | 0.31 |
| 173 | FUCA1 | 1.3 | 5.17 | 2.97 | 1.64 | 5.7 |
| 174 | TM6SF2 | 0.9 | 0.64 | 0.68 | 0.87 | 0.69 |
| 175 | KCNK9 | 2.24 | 1.45 | 1.17 | 1.82 | 1.95 |

TABLE 9C-continued

| | | Testing: Good (G) and Poor (P) (3rd and 4th Bars of FIG. 7A) | | | | |
|---|---|---|---|---|---|---|
| 176 | ADCYAP1 | 16.37 | 4.15 | 1.09 | 21.82 | 3.19 |
| 177 | PLXNA4 | 1.57 | 2.41 | 2.02 | 1.25 | 1.52 |
| 178 | HLA-DMB | 0.73 | 2.76 | 1.53 | 0.99 | 2.48 |
| 179 | est | 0.53 | 0.97 | 0.4 | 0.45 | 0.75 |
| 180 | est | 0.08 | 0.14 | 0.19 | 0.14 | 0.39 |
| 181 | GRIN3A | 1.15 | 1.36 | 0.62 | 0.65 | 0.59 |
| 182 | OSBPL3 | 3.81 | 2.35 | 8.94 | 4.45 | 3.72 |
| 183 | ODZ4 | 2.53 | 4.69 | 2.21 | 1.64 | 4.29 |
| 184 | est | 9.36 | 18.04 | 1.22 | 2.01 | 5.05 |
| 185 | E2F1 | 0.6 | 0.2 | 0.72 | 0.25 | 0.33 |
| 186 | MGC16664 | 22.76 | 17.82 | 15.1 | 11.58 | 7.22 |
| 187 | HMP19 | 100 | 86.88 | 39.73 | 70.97 | 75.48 |
| 188 | IL2RB | 0.53 | 2.01 | 1.38 | 0.98 | 1.74 |
| 189 | TOPK | 0.22 | 0.13 | 0.23 | 0.09 | 0.25 |
| 190 | ALDH1A1 | 1.55 | 2.78 | 1.7 | 2.44 | 5.12 |
| 191 | CED-6 | 0.28 | 0.11 | 0.11 | 0.39 | 0.34 |
| 192 | est | 2.02 | 1.56 | 0.97 | 0.67 | 0.71 |
| 193 | A2BP1 | 5.75 | 2.36 | 6.74 | 5.22 | 6.75 |
| 194 | LY6E | 0.21 | 0.24 | 0.18 | 0.3 | 0.17 |
| 195 | est | 1.77 | 1.72 | 1.06 | 1.52 | 4.29 |
| 196 | est | 0.32 | 0.42 | 0.59 | 0.65 | 0.88 |
| 197 | PLXNC1 | 10.01 | 21.01 | 9.98 | 11.87 | 13.77 |
| 198 | EFS | 0.2 | 0.23 | 0.88 | 0.29 | 0.38 |
| 199 | ACTN2 | 0.79 | 1.53 | 2.53 | 2.57 | 2.41 |
| 200 | MYC | 0.04 | 0.11 | 0.07 | 0.09 | 0.16 |
| 201 | KIAA0527 | 0.44 | 0.26 | 0.3 | 0.33 | 0.27 |
| 202 | C6orf31 | 0.31 | 0.2 | 6.3 | 0.37 | 0.24 |
| 203 | DLL3 | 0.71 | 1.12 | 1.58 | 2.03 | 0.94 |
| 204 | est | 0.96 | 0.76 | 0.99 | 1.55 | 0.69 |
| 205 | STK33 | 0.46 | 0.88 | 0.49 | 0.8 | 0.62 |
| 206 | SEMA3A | 0.75 | 1.41 | 0.76 | 0.69 | 1.09 |
| 207 | est | 7.3 | 3.29 | 2.56 | 2.6 | 1.9 |
| 208 | IGSF4 | 13.14 | 18.07 | 9.94 | 7.1 | 6.88 |
| 209 | CKS2 | 0.11 | 0.07 | 0.16 | 0.07 | 0.16 |
| 210 | est | 2.42 | 3.45 | 2.4 | 1.42 | 3.29 |
| 211 | est | 0.87 | 0.25 | 0.53 | 0.41 | 0.58 |
| 212 | SIX3 | 25.3 | 20.41 | 2.95 | 6.26 | 4.66 |
| 213 | FLJ22002 | 0.2 | 0.08 | 0.24 | 0.22 | 0.18 |
| 214 | HSD17B12 | 0.68 | 0.48 | 0.55 | 0.99 | 0.85 |
| 215 | HBA2 | 0.12 | 0.07 | 0.19 | 0.53 | 1.85 |
| 216 | CDH11 | 1.78 | 1.36 | 1.52 | 0.9 | 1.75 |
| 217 | RGS9 | 2.95 | 3.45 | 1.46 | 1.6 | 1.79 |
| 218 | est | 3.12 | 3.09 | 2.11 | 1.97 | 1.75 |
| 219 | NCAM2 | 1.81 | 4.02 | 1.22 | 1.38 | 0.93 |
| 220 | BIRC5 | 0.27 | 0.09 | 0.26 | 0.06 | 0.16 |
| 221 | est | 1.05 | 1.17 | 1.34 | 1.07 | 1.25 |
| 222 | GNG12 | 0.28 | 0.88 | 0.32 | 0.35 | 0.52 |
| 223 | GPIG4 | 0.7 | 1.68 | 0.79 | 1.81 | 1.13 |
| 224 | est | 1.54 | 1.65 | 1.64 | 1.94 | 1.54 |
| 225 | ENPP4 | 0.53 | 0.69 | 0.51 | 1.24 | 3.58 |
| 226 | FMNL | 1.17 | 0.46 | 1.2 | 1.13 | 0.56 |
| 227 | est | 0.3 | 0.36 | 0.39 | 0.43 | 0.73 |
| 228 | PIWIL2 | 0.43 | 0.56 | 0.82 | 2.78 | 0.53 |
| 229 | CLSTN1 | 1.14 | 1.03 | 1.03 | 0.75 | 0.84 |
| 230 | UHRF1 | 0.12 | 0.07 | 0.16 | 0.13 | 0.19 |
| 231 | est | 0.24 | 0.42 | 0.27 | 0.38 | 0.46 |
| 232 | SLC40A1 | 1.2 | 1.99 | 3.21 | 1.84 | 5.76 |
| 233 | CLECSF6 | 2.37 | 6.85 | 3.62 | 2.77 | 5.71 |
| 234 | est | 1.35 | 1.99 | 1.18 | 2.65 | 2.09 |
| 235 | BKLHD2 | 1.93 | 2.18 | 2.18 | 2.6 | 1.93 |
| 236 | est | 3.11 | 5.36 | 1.03 | 1.28 | 2.65 |
| 237 | est | 0.33 | 0.34 | 8.76 | 0.33 | 0.3 |
| 238 | est | 1.28 | 2.13 | 1.59 | 1.46 | 1.39 |
| 239 | SORCS1 | 5.88 | 12.43 | 9.52 | 13.24 | 10.5 |
| 240 | NRP2 | 14.44 | 30.86 | 9.01 | 6.94 | 12.83 |
| 241 | E2-EPF | 0.52 | 0.15 | 0.39 | 0.21 | 0.22 |
| 242 | CAST | 0.48 | 2.65 | 1.59 | 1.3 | 1.89 |
| 243 | KIAA1384 | 7.94 | 2.82 | 2.75 | 1.52 | 2.32 |
| 244 | KIAA0644 | 0.89 | 1.03 | 1.65 | 1.25 | 1.22 |
| 245 | HLA-DRB3 | 0.97 | 6.85 | 3.39 | 1.8 | 3.51 |
| 246 | PMP22 | 3.53 | 9.71 | 5.59 | 6.62 | 4.94 |
| 247 | DJ79P11.1 | 12.96 | 7.63 | 5.67 | 7.32 | 5.33 |
| 248 | SOX5 | 1.33 | 2.24 | 2.25 | 2.57 | 3.81 |
| 249 | CD3E | 9.81 | 12.43 | 4.25 | 5.82 | 7.73 |
| 250 | est | 4.56 | 3.38 | 3.88 | 3.05 | 4.49 |

TABLE 9C-continued

Testing: Good (G) and Poor (P) (3rd and 4th Bars of FIG. 7A)

| Rank | St2_NA_NB220 (G) | St2_NA_NB232 (G) | St2_NA_NB235 (G) | St3_NA_NB201 (G) | St3_NA_NB215 (G) |
|---|---|---|---|---|---|
| 1 | 0.02 | 0.14 | 0.28 | 0.04 | 0.02 |
| 2 | 0.48 | 0.24 | 0.22 | 1.25 | 0.29 |
| 3 | 3.79 | 1.91 | 1.12 | 3.15 | 5.64 |
| 4 | 2.5 | 3.27 | 0.69 | 1.06 | 49.91 |
| 5 | 8.38 | 7.74 | 3.66 | 3 | 5 |
| 6 | 14.74 | 35.88 | 9.16 | 11.63 | 61.29 |
| 7 | 31.82 | 6.31 | 11.88 | 18.54 | 4.68 |
| 8 | 0.07 | 1.25 | 0.08 | 0.23 | 1.1 |
| 9 | 0.99 | 0.61 | 0.29 | 0.35 | 0.89 |
| 10 | 0.74 | 0.52 | 0.4 | 0.37 | 0.57 |
| 11 | 0.48 | 0.17 | 0.34 | 0.33 | 0.09 |
| 12 | 2.75 | 1.88 | 1.25 | 2.34 | 3.24 |
| 13 | 2.86 | 0.61 | 3.07 | 2.52 | 0.57 |
| 14 | 10.89 | 3.81 | 21.67 | 22.91 | 2.29 |
| 15 | 0.61 | 0.73 | 1.08 | 0.95 | 0.68 |
| 16 | 4.88 | 0.97 | 9.84 | 5.66 | 0.64 |
| 17 | 26.8 | 4.97 | 26.5 | 11.15 | 14.05 |
| 18 | 0.05 | 0.08 | 0.03 | 0.12 | 0.04 |
| 19 | 0.07 | 0.13 | 0.04 | 0.08 | 0.14 |
| 20 | 55.15 | 31.72 | 34.96 | 38.78 | 8.62 |
| 21 | 2.14 | 12.52 | 1.16 | 4.17 | 3.09 |
| 22 | 0.04 | 0.09 | 0.14 | 0.19 | 1.13 |
| 23 | 1.48 | 0.18 | 1.24 | 2.28 | 6.15 |
| 24 | 0.92 | 1.37 | 0.71 | 0.97 | 2.18 |
| 25 | 14.26 | 6.65 | 15.09 | 7.98 | 27.49 |
| 26 | 10.01 | 15.73 | 13.2 | 13.17 | 26.71 |
| 27 | 0.09 | 0.18 | 0.06 | 0.22 | 0.1 |
| 28 | 21.84 | 7.73 | 27.88 | 39.81 | 40.43 |
| 29 | 0.03 | 0.29 | 0.07 | 0.22 | 0.05 |
| 30 | 0.62 | 0.28 | 0.4 | 0.77 | 0.17 |
| 31 | 9.98 | 16.11 | 13.09 | 12.73 | 0.18 |
| 32 | 100 | 7.02 | 9.95 | 20.92 | 2.36 |
| 33 | 0.89 | 1.61 | 2.67 | 0.84 | 1.18 |
| 34 | 0.08 | 0.16 | 0.07 | 0.32 | 0.36 |
| 35 | 4.88 | 2.01 | 10.86 | 2.53 | 10.98 |
| 36 | 18.98 | 6.23 | 0.3 | 3.55 | 8.54 |
| 37 | 0.97 | 0.7 | 0.61 | 0.43 | 0.46 |
| 38 | 2.51 | 0.03 | 0.15 | 0.63 | 3.84 |
| 39 | 3.33 | 0.92 | 0.62 | 4.91 | 4.02 |
| 40 | 11.42 | 3.32 | 1.73 | 3.25 | 5.84 |
| 41 | 6.87 | 1.51 | 1.39 | 2.96 | 7.61 |
| 42 | 4.2 | 5.02 | 1.59 | 10.46 | 1.45 |
| 43 | 0.2 | 0.26 | 0.12 | 0.34 | 0.28 |
| 44 | 0.87 | 1.19 | 0.68 | 0.76 | 0.84 |
| 45 | 1.07 | 0.5 | 3.08 | 1.07 | 0.49 |
| 46 | 5.08 | 2.02 | 3.13 | 2.35 | 7.46 |
| 47 | 0.67 | 0.31 | 0.41 | 0.79 | 0.17 |
| 48 | 0.06 | 0.67 | 0.1 | 0.3 | 1.05 |
| 49 | 0.75 | 0.42 | 0.5 | 0.29 | 5.7 |
| 50 | 0.1 | 1.2 | 0.39 | 0.16 | 0.27 |
| 51 | 0.46 | 0.56 | 0.35 | 0.39 | 0.44 |
| 52 | 0.45 | 0.28 | 0.28 | 0.28 | 0.3 |
| 53 | 16.85 | 1.23 | 15.37 | 12.93 | 1.21 |
| 54 | 1.16 | 2.26 | 1.04 | 3.59 | 0.96 |
| 55 | 2.72 | 2.39 | 1.03 | 1.41 | 3.28 |
| 56 | 1.01 | 1.3 | 0.96 | 0.78 | 0.74 |
| 57 | 5.75 | 1.83 | 1.53 | 6.91 | 3.65 |
| 58 | 39.88 | 15.38 | 11.41 | 17.11 | 11.2 |
| 59 | 3.99 | 4 | 4.11 | 1.02 | 2.03 |
| 60 | 17.42 | 17.79 | 22.31 | 23.07 | 28.58 |
| 61 | 18.12 | 15.95 | 19.53 | 22.59 | 27.38 |
| 62 | 0.69 | 1.18 | 1.7 | 1.01 | 2.01 |
| 63 | 17.25 | 3.53 | 10.23 | 11.04 | 2.63 |
| 64 | 2.68 | 2.27 | 10.43 | 25.16 | 4.93 |
| 65 | 3.12 | 5.87 | 16.51 | 8.67 | 4.02 |
| 66 | 0.47 | 0.46 | 2.38 | 0.51 | 0.53 |
| 67 | 0.62 | 0.62 | 0.51 | 0.65 | 0.81 |
| 68 | 5.28 | 1.58 | 6.87 | 5.84 | 1.63 |
| 69 | 9.33 | 10.74 | 11.13 | 7.48 | 2.57 |
| 70 | 0.03 | 0.05 | 0.03 | 0.15 | 0.03 |
| 71 | 2.89 | 1.41 | 6.91 | 5.59 | 2.24 |
| 72 | 63.16 | 7.92 | 69.99 | 56.35 | 6.77 |
| 73 | 6.57 | 64.03 | 10.28 | 31.91 | 19.91 |
| 74 | 1.78 | 0.56 | 2.88 | 1.51 | 1.42 |
| 75 | 4.08 | 1.66 | 2.37 | 3.49 | 1.44 |

TABLE 9C-continued

Testing: Good (G) and Poor (P) (3rd and 4th Bars of FIG. 7A)

| | | | | | |
|---|---|---|---|---|---|
| 76 | 13.67 | 2.84 | 7.78 | 10.15 | 2.56 |
| 77 | 14.77 | 4.98 | 22.57 | 27.6 | 4.55 |
| 78 | 6.23 | 2.64 | 11.53 | 3.73 | 10.59 |
| 79 | 11.93 | 8.13 | 14.92 | 8.21 | 3.22 |
| 80 | 3.18 | 5.69 | 3.13 | 8.02 | 6.27 |
| 81 | 15.44 | 12.62 | 21.31 | 14.7 | 6.36 |
| 82 | 0.61 | 0.35 | 0.64 | 0.77 | 0.51 |
| 83 | 0.8 | 0.88 | 0.62 | 0.78 | 0.55 |
| 84 | 0.8 | 0.62 | 0.87 | 1.12 | 0.57 |
| 85 | 2.06 | 0.16 | 0.21 | 0.53 | 4.36 |
| 86 | 0.62 | 0.33 | 0.16 | 0.48 | 1.15 |
| 87 | 1.94 | 0.83 | 6.19 | 1.49 | 0.57 |
| 88 | 0.64 | 0.39 | 0.44 | 1.05 | 0.53 |
| 89 | 0.12 | 0.26 | 0.1 | 0.12 | 0.24 |
| 90 | 0.18 | 0.31 | 0.21 | 0.16 | 0.21 |
| 91 | 1.36 | 0.42 | 1.51 | 2.43 | 0.35 |
| 92 | 0.17 | 0.13 | 0.03 | 0.18 | 0.04 |
| 93 | 0.07 | 0.53 | 0.14 | 0.37 | 1.68 |
| 94 | 0.21 | 0.26 | 1.74 | 0.92 | 0.12 |
| 95 | 6.05 | 3.66 | 13.62 | 7.4 | 2.62 |
| 96 | 0.03 | 0.06 | 0.08 | 0.04 | 0.5 |
| 97 | 1.16 | 0.28 | 1.55 | 2.3 | 0.48 |
| 98 | 5.56 | 3.99 | 1.65 | 1.17 | 1.1 |
| 99 | 0.54 | 0.27 | 0.36 | 0.6 | 0.13 |
| 100 | 50.02 | 19.01 | 76.19 | 27.79 | 6.8 |
| 101 | 16.3 | 8.5 | 16.43 | 6.41 | 3.91 |
| 102 | 0.92 | 1.27 | 0.9 | 0.89 | 1.06 |
| 103 | 3.26 | 1.24 | 0.78 | 1.02 | 1.24 |
| 104 | 1.88 | 0.63 | 2.25 | 2.43 | 0.64 |
| 105 | 0.7 | 2.16 | 0.54 | 2.89 | 7.84 |
| 106 | 5.63 | 1.77 | 2.87 | 2.54 | 1.59 |
| 107 | 0.36 | 0.5 | 0.16 | 0.39 | 1.35 |
| 108 | 9.86 | 27.95 | 53.03 | 27.53 | 4.27 |
| 109 | 0.54 | 0.54 | 0.23 | 0.55 | 0.94 |
| 110 | 1.29 | 1.5 | 3.03 | 1.31 | 1.53 |
| 111 | 100 | 72.5 | 84.87 | 57.85 | 83.41 |
| 112 | 17.18 | 2.56 | 3.21 | 7.82 | 1.6 |
| 113 | 4.93 | 1.54 | 3.51 | 2.94 | 1.03 |
| 114 | 0.98 | 1.19 | 3.41 | 0.65 | 1.09 |
| 115 | 2.22 | 1.91 | 1.06 | 1.46 | 1.8 |
| 116 | 0.14 | 0.32 | 0.15 | 0.52 | 0.25 |
| 117 | 0.38 | 0.19 | 0.24 | 0.45 | 0.16 |
| 118 | 11.55 | 6.2 | 10.71 | 2.49 | 2.55 |
| 119 | 9.83 | 10.26 | 3.4 | 4.33 | 8.74 |
| 120 | 0.64 | 0.85 | 1.37 | 1.52 | 0.76 |
| 121 | 14.48 | 5.03 | 7.43 | 5.15 | 8.47 |
| 122 | 2.5 | 2.85 | 6.77 | 2.75 | 1.34 |
| 123 | 3.24 | 1.79 | 2.51 | 3.23 | 1.21 |
| 124 | 1.18 | 0.86 | 2.45 | 1.44 | 1.57 |
| 125 | 0.66 | 2.02 | 1.46 | 8.44 | 75.87 |
| 126 | 0.98 | 15.71 | 1.02 | 2.83 | 23.25 |
| 127 | 1.19 | 1.26 | 2.59 | 0.94 | 1.7 |
| 128 | 1.71 | 0.94 | 0.69 | 0.85 | 0.33 |
| 129 | 0.81 | 1.09 | 3.59 | 2.29 | 1.05 |
| 130 | 13.73 | 15 | 14.56 | 24.42 | 27.17 |
| 131 | 4.6 | 2.77 | 7.94 | 6.25 | 1.77 |
| 132 | 19.65 | 7.49 | 4.63 | 19.43 | 5.55 |
| 133 | 7.68 | 1.3 | 5.49 | 2.35 | 1.13 |
| 134 | 1.43 | 0.7 | 2.21 | 1.63 | 0.79 |
| 135 | 0.75 | 0.45 | 0.62 | 0.56 | 0.58 |
| 136 | 0.62 | 0.49 | 0.36 | 0.38 | 0.61 |
| 137 | 0.14 | 0.11 | 0.07 | 0.21 | 0.41 |
| 138 | 12.46 | 7.95 | 1.22 | 3.52 | 5.09 |
| 139 | 1.85 | 0.87 | 1.53 | 1.1 | 0.52 |
| 140 | 7.37 | 76.94 | 20.71 | 10.11 | 37.72 |
| 141 | 0.75 | 1.04 | 1.74 | 1.21 | 2.39 |
| 142 | 2.44 | 1.55 | 4.98 | 3.1 | 1.46 |
| 143 | 13.99 | 16.96 | 6.35 | 9.56 | 9.31 |
| 144 | 1.04 | 1.66 | 1.05 | 1.14 | 2.31 |
| 145 | 0.01 | 0.06 | 0.02 | 0.33 | 2.02 |
| 146 | 25.41 | 5.98 | 12.08 | 12.05 | 4.84 |
| 147 | 0.7 | 0.83 | 0.44 | 0.75 | 0.86 |
| 148 | 5.32 | 12.47 | 7.47 | 3.31 | 5.75 |
| 149 | 3.75 | 2.99 | 5.08 | 5.32 | 2.93 |
| 150 | 0.13 | 0.3 | 2.96 | 0.8 | 0.11 |
| 151 | 2.01 | 2.19 | 1.84 | 1.75 | 1.5 |
| 152 | 1.36 | 2.31 | 1.3 | 4.87 | 1.42 |
| 153 | 1.02 | 0.52 | 0.71 | 0.92 | 2.19 |

TABLE 9C-continued

| | Testing: Good (G) and Poor (P) (3rd and 4th Bars of FIG. 7A) | | | | |
|---|---|---|---|---|---|
| 154 | 8.54 | 3.44 | 4.82 | 6.87 | 20.26 |
| 155 | 0.09 | 0.15 | 0.08 | 0.96 | 9 |
| 156 | 1.14 | 15.94 | 3.1 | 3.06 | 5.8 |
| 157 | 0.16 | 0.14 | 1.67 | 0.56 | 0.06 |
| 158 | 0.55 | 0.44 | 0.46 | 0.48 | 0.43 |
| 159 | 0.1 | 0.06 | 0.75 | 0.69 | 0.07 |
| 160 | 0.43 | 0.06 | 0.76 | 0.48 | 0.03 |
| 161 | 0.45 | 0.5 | 0.52 | 0.75 | 1.64 |
| 162 | 9.58 | 5.16 | 12.66 | 4.92 | 2.74 |
| 163 | 31.2 | 35.52 | 41.94 | 11.54 | 28.89 |
| 164 | 5.9 | 3.4 | 3.3 | 4.25 | 5.82 |
| 165 | 0.1 | 0.36 | 0.04 | 0.08 | 0.32 |
| 166 | 4.12 | 3.06 | 6.29 | 5.57 | 4.65 |
| 167 | 100 | 25.25 | 100 | 48.71 | 37.99 |
| 168 | 5.57 | 6.88 | 14.69 | 11.72 | 0.26 |
| 169 | 0.01 | 0.02 | 0.01 | 0.01 | 0.01 |
| 170 | 20.5 | 3.17 | 26.29 | 15.85 | 11.99 |
| 171 | 1.2 | 17.8 | 1.05 | 3.42 | 31.06 |
| 172 | 0.53 | 0.15 | 0.13 | 2.02 | 0.3 |
| 173 | 3.11 | 1.55 | 1.05 | 1.89 | 2.47 |
| 174 | 1.4 | 0.86 | 1.8 | 3.58 | 0.93 |
| 175 | 0.77 | 1.4 | 1.36 | 1.01 | 1.34 |
| 176 | 1.49 | 4.88 | 3.39 | 1.8 | 56.37 |
| 177 | 1.91 | 0.87 | 1.85 | 1.77 | 0.67 |
| 178 | 1.56 | 2.23 | 0.4 | 1.4 | 3.82 |
| 179 | 1.49 | 1.8 | 1.71 | 2.24 | 1.3 |
| 180 | 0.16 | 0.37 | 0.07 | 0.18 | 0.54 |
| 181 | 0.46 | 1.04 | 0.84 | 1.03 | 0.69 |
| 182 | 2.62 | 1.03 | 3.07 | 1.86 | 1.23 |
| 183 | 2.18 | 2.63 | 4.21 | 1.69 | 3.82 |
| 184 | 18.05 | 14.79 | 6.63 | 25.49 | 5.22 |
| 185 | 0.09 | 0.24 | 1.05 | 0.67 | 0.09 |
| 186 | 20.9 | 8.29 | 15.63 | 18.53 | 13 |
| 187 | 100 | 37.95 | 65.01 | 54.06 | 100 |
| 188 | 1.09 | 1.9 | 0.38 | 1.1 | 5.13 |
| 189 | 0.05 | 0.06 | 0.94 | 0.75 | 0.04 |
| 190 | 1.83 | 3.92 | 1.28 | 10 | 12.6 |
| 191 | 0.12 | 0.47 | 0.14 | 0.48 | 0.79 |
| 192 | 1.22 | 1.16 | 0.92 | 2.5 | 1.25 |
| 193 | 3.4 | 2.86 | 4.03 | 5.09 | 2.44 |
| 194 | 0.15 | 0.26 | 0.21 | 0.23 | 0.37 |
| 195 | 2.11 | 2.29 | 2.42 | 1.63 | 2.06 |
| 196 | 0.52 | 0.88 | 0.53 | 1.04 | 2.01 |
| 197 | 16.84 | 6.94 | 15.81 | 13.07 | 4.49 |
| 198 | 0.41 | 0.67 | 6.12 | 1.9 | 0.81 |
| 199 | 1.59 | 1.71 | 0.15 | 0.75 | 0.47 |
| 200 | 0.11 | 0.39 | 0.04 | 0.12 | 0.35 |
| 201 | 0.14 | 0.31 | 0.08 | 0.28 | 0.26 |
| 202 | 6.26 | 6.55 | 11.2 | 6.95 | 0.32 |
| 203 | 2.08 | 0.38 | 0.26 | 0.63 | 0.75 |
| 204 | 0.51 | 0.61 | 1.66 | 0.87 | 0.6 |
| 205 | 0.43 | 0.48 | 0.3 | 0.43 | 0.61 |
| 206 | 0.67 | 0.43 | 1.38 | 0.59 | 0.6 |
| 207 | 4.85 | 1.35 | 9.85 | 30.3 | 0.92 |
| 208 | 17.4 | 25.81 | 100 | 25.87 | 4.76 |
| 209 | 0.05 | 0.1 | 0.31 | 0.16 | 0.06 |
| 210 | 1.75 | 0.8 | 1.74 | 2.02 | 1.02 |
| 211 | 0.38 | 0.27 | 3.55 | 1.04 | 0.22 |
| 212 | 64.92 | 22.59 | 43.3 | 77.09 | 6.16 |
| 213 | 0.07 | 0.18 | 0.8 | 0.32 | 0.7 |
| 214 | 0.4 | 0.92 | 0.92 | 0.43 | 0.87 |
| 215 | 0.12 | 1.08 | 0.15 | 0.55 | 0.43 |
| 216 | 0.53 | 1.63 | 0.71 | 0.88 | 1.33 |
| 217 | 3.44 | 3.92 | 1.88 | 3.38 | 3.95 |
| 218 | 2.46 | 2.02 | 2.7 | 1.93 | 1.3 |
| 219 | 3.83 | 0.86 | 1.34 | 5.07 | 0.84 |
| 220 | 0.02 | 0.04 | 0.6 | 0.31 | 0.02 |
| 221 | 1.2 | 0.91 | 2 | 1 | 1.02 |
| 222 | 1.34 | 1.02 | 0.22 | 0.59 | 1.07 |
| 223 | 1.15 | 4.26 | 0.94 | 1.7 | 1.3 |
| 224 | 5.22 | 5.06 | 1.45 | 14.42 | 1.63 |
| 225 | 0.4 | 0.85 | 1.25 | 4.26 | 3.6 |
| 226 | 0.84 | 0.42 | 0.79 | 1.63 | 0.68 |
| 227 | 0.12 | 0.64 | 0.49 | 0.36 | 1.19 |
| 228 | 0.53 | 1.29 | 0.61 | 0.45 | 0.75 |
| 229 | 0.57 | 0.39 | 0.27 | 0.43 | 0.62 |
| 230 | 0.06 | 0.06 | 0.22 | 0.11 | 0.09 |
| 231 | 0.32 | 0.44 | 0.09 | 0.13 | 0.67 |

TABLE 9C-continued

Testing: Good (G) and Poor (P) (3rd and 4th Bars of FIG. 7A)

| | | | | | |
|---|---|---|---|---|---|
| 232 | 3.78 | 2.01 | 1.09 | 2.85 | 5.41 |
| 233 | 4.23 | 4.19 | 2.67 | 3.62 | 6.19 |
| 234 | 2.28 | 2.12 | 2.43 | 2.29 | 1.74 |
| 235 | 4.37 | 2.19 | 5.18 | 3.67 | 1.48 |
| 236 | 2.58 | 1.13 | 1.07 | 1.24 | 3.64 |
| 237 | 12.06 | 9.86 | 18.3 | 14.28 | 0.37 |
| 238 | 2.08 | 1.26 | 2.48 | 1.48 | 0.48 |
| 239 | 11.22 | 17.68 | 39.79 | 27.82 | 18.56 |
| 240 | 34.92 | 12.64 | 43.35 | 17.69 | 16.29 |
| 241 | 0.15 | 0.12 | 0.42 | 0.4 | 0.22 |
| 242 | 1.55 | 2.12 | 0.63 | 1.52 | 6.27 |
| 243 | 7.09 | 4.42 | 1.28 | 3.55 | 1.28 |
| 244 | 0.46 | 0.15 | 0.34 | 0.27 | 0.35 |
| 245 | 1.83 | 3.75 | 0.93 | 2.85 | 9.61 |
| 246 | 6.58 | 6.99 | 4.21 | 7.34 | 8.99 |
| 247 | 7.21 | 6.7 | 10.57 | 7.33 | 10.26 |
| 248 | 1.7 | 1.61 | 3.56 | 1.7 | 1.3 |
| 249 | 6.99 | 2.59 | 11.29 | 3.96 | 6.69 |
| 250 | 1.41 | 1.79 | 3.83 | 1.25 | 1.26 |

| Rank | St4_NA_NB24 (G) | St4_NA_NB269 (G) | St4_NA_NB282 (G) | St4_NA_NB35 (G) | St4_NA_NB64 (G) |
|---|---|---|---|---|---|
| 1 | 0.03 | 0.03 | 0.05 | 0.01 | 0.06 |
| 2 | 0.28 | 0.8 | 1.18 | 0.31 | 0.34 |
| 3 | 0.8 | 3.11 | 1.32 | 2.45 | 1.7 |
| 4 | 1.1 | 3.41 | 4.98 | 1.49 | 2.28 |
| 5 | 1.39 | 4.74 | 3.46 | 5.74 | 2.33 |
| 6 | 6.47 | 38.97 | 5.75 | 61.03 | 12.61 |
| 7 | 15.11 | 4.98 | 1 | 1.4 | 7.14 |
| 8 | 0.14 | 0.99 | 1 | 0.55 | 0.2 |
| 9 | 0.26 | 1.26 | 0.06 | 0.37 | 1.46 |
| 10 | 0.85 | 0.81 | 2.37 | 1.01 | 1.99 |
| 11 | 0.42 | 0.19 | 0.1 | 0.1 | 0.23 |
| 12 | 1.02 | 2.51 | 0.65 | 2.08 | 3.68 |
| 13 | 5.59 | 0.39 | 0.55 | 0.22 | 1.75 |
| 14 | 18.84 | 2.49 | 1.6 | 1.99 | 3.71 |
| 15 | 0.86 | 0.42 | 0.38 | 0.38 | 1.11 |
| 16 | 4.87 | 0.72 | 1.28 | 1.56 | 5.72 |
| 17 | 4.46 | 6.39 | 1.31 | 6.8 | 34.8 |
| 18 | 0.11 | 0.1 | 0.09 | 0.14 | 0.15 |
| 19 | 0.07 | 0.14 | 0.13 | 0.21 | 0.06 |
| 20 | 73.63 | 27.24 | 4 | 4.03 | 2.38 |
| 21 | 0.51 | 9.92 | 2.9 | 1.67 | 1.49 |
| 22 | 0.12 | 0.15 | 0.39 | 0.19 | 0.06 |
| 23 | 0.44 | 0.32 | 1.66 | 0.5 | 2.69 |
| 24 | 1.22 | 2.06 | 0.81 | 2.43 | 2.68 |
| 25 | 28.54 | 2.72 | 6.32 | 18.14 | 30.6 |
| 26 | 15.39 | 23.58 | 5.43 | 16.55 | 8.08 |
| 27 | 0.08 | 0.64 | 0.1 | 0.05 | 0.48 |
| 28 | 16.99 | 11.36 | 2.53 | 9.09 | 37.79 |
| 29 | 0.04 | 0.09 | 0.33 | 0.17 | 0.73 |
| 30 | 0.26 | 0.35 | 0.05 | 0.09 | 0.33 |
| 31 | 0.04 | 0.18 | 0.06 | 9.95 | 0.39 |
| 32 | 5.23 | 5.06 | 3.5 | 1.63 | 13.54 |
| 33 | 0.9 | 3.9 | 0.96 | 1 | 2.08 |
| 34 | 0.17 | 0.65 | 0.12 | 0.66 | 0.11 |
| 35 | 11.84 | 2.91 | 31.49 | 2.93 | 5.56 |
| 36 | 2.87 | 12.53 | 0.31 | 1.56 | 4.07 |
| 37 | 0.81 | 0.92 | 2.34 | 0.9 | 1.86 |
| 38 | 1.39 | 0.49 | 0.07 | 0.05 | 0.1 |
| 39 | 0.37 | 4.76 | 0.89 | 0.37 | 3.7 |
| 40 | 0.88 | 5.21 | 1.63 | 6.2 | 5.01 |
| 41 | 1.04 | 5.28 | 1.18 | 1.1 | 1.68 |
| 42 | 2.03 | 2.72 | 1.23 | 0.86 | 0.91 |
| 43 | 0.23 | 2.28 | 0.45 | 0.73 | 7.23 |
| 44 | 5.45 | 0.72 | 5.15 | 1.44 | 3.04 |
| 45 | 1.39 | 0.49 | 0.24 | 0.69 | 0.31 |
| 46 | 0.3 | 2.53 | 0.45 | 1.13 | 4.84 |
| 47 | 0.24 | 0.35 | 0.06 | 0.07 | 0.32 |
| 48 | 0.09 | 0.7 | 0.09 | 1.07 | 0.17 |
| 49 | 0.38 | 0.38 | 0.15 | 0.07 | 0.36 |
| 50 | 0.13 | 0.24 | 3.05 | 0.32 | 0.18 |
| 51 | 0.5 | 0.56 | 0.72 | 0.45 | 0.37 |
| 52 | 0.28 | 0.24 | 4.06 | 0.63 | 0.29 |
| 53 | 9 | 0.84 | 5.42 | 3.67 | 12.38 |
| 54 | 1.28 | 1.17 | 0.89 | 0.57 | 0.79 |
| 55 | 1.06 | 2.8 | 1.13 | 1.2 | 1.78 |

TABLE 9C-continued

Testing: Good (G) and Poor (P) (3rd and 4th Bars of FIG. 7A)

| | | | | | |
|---|---|---|---|---|---|
| 56 | 4.87 | 0.74 | 4.6 | 1.49 | 2.99 |
| 57 | 0.58 | 4.93 | 2.01 | 1.33 | 5.29 |
| 58 | 10.14 | 17.31 | 2.65 | 3.9 | 23.09 |
| 59 | 1.46 | 3.04 | 0.55 | 3.18 | 1.54 |
| 60 | 33.43 | 17.2 | 29.36 | 10.48 | 22.89 |
| 61 | 25.5 | 17.32 | 31.1 | 10.44 | 27.49 |
| 62 | 2.22 | 1.16 | 1.46 | 0.69 | 2.24 |
| 63 | 8.75 | 2.96 | 9.3 | 2.48 | 5.38 |
| 64 | 2.66 | 2.28 | 1.53 | 1.49 | 2.02 |
| 65 | 21.54 | 4.86 | 6.07 | 2.42 | 2.27 |
| 66 | 0.64 | 0.53 | 0.17 | 0.76 | 1.12 |
| 67 | 1.24 | 0.55 | 3.4 | 1.45 | 4.96 |
| 68 | 1.96 | 1.02 | 0.51 | 0.42 | 4.86 |
| 69 | 8.1 | 2.65 | 5.47 | 1.64 | 16.08 |
| 70 | 0.02 | 0.03 | 0.03 | 0.02 | 0.04 |
| 71 | 5.15 | 3.47 | 1.57 | 4 | 4.39 |
| 72 | 42.8 | 5.34 | 4.9 | 9.81 | 18.18 |
| 73 | 52.95 | 13.7 | 40.87 | 98.22 | 21.27 |
| 74 | 2.73 | 0.63 | 0.51 | 0.38 | 1.47 |
| 75 | 2.09 | 1.75 | 1.16 | 1.53 | 1.16 |
| 76 | 8.73 | 2.67 | 9.65 | 2.27 | 5.01 |
| 77 | 24.22 | 4.13 | 2.65 | 3.79 | 7.84 |
| 78 | 9.51 | 3.7 | 15.84 | 2.84 | 8.45 |
| 79 | 4.93 | 6.36 | 2.57 | 2.87 | 3.84 |
| 80 | 20.25 | 10.81 | 2.58 | 0.74 | 1.45 |
| 81 | 10.1 | 5.56 | 6.61 | 14.06 | 14.38 |
| 82 | 1.01 | 0.62 | 0.25 | 0.14 | 0.2 |
| 83 | 0.36 | 0.39 | 0.46 | 0.65 | 0.51 |
| 84 | 0.94 | 1.35 | 0.4 | 0.72 | 1.37 |
| 85 | 1.04 | 0.48 | 0.29 | 0.13 | 0.16 |
| 86 | 0.46 | 0.84 | 0.37 | 2.14 | 0.6 |
| 87 | 1.7 | 0.67 | 0.53 | 0.71 | 0.32 |
| 88 | 0.49 | 0.65 | 0.84 | 0.49 | 0.78 |
| 89 | 0.13 | 0.18 | 0.12 | 0.27 | 0.07 |
| 90 | 0.13 | 0.24 | 0.49 | 0.31 | 0.27 |
| 91 | 2.48 | 0.75 | 0.18 | 0.89 | 0.73 |
| 92 | 0.1 | 0.07 | 1.61 | 0.27 | 0.9 |
| 93 | 0.12 | 1.27 | 0.45 | 0.71 | 0.36 |
| 94 | 1.19 | 0.13 | 0.79 | 0.34 | 1.11 |
| 95 | 14.45 | 3.1 | 1.62 | 4.88 | 2.45 |
| 96 | 0.33 | 0.1 | 0.06 | 1.84 | 0.06 |
| 97 | 0.96 | 0.33 | 1.56 | 0.58 | 1.98 |
| 98 | 1.26 | 1.13 | 1.03 | 0.67 | 0.97 |
| 99 | 0.17 | 0.22 | 0.07 | 0.08 | 0.24 |
| 100 | 17.51 | 4.87 | 7.89 | 11.71 | 12.32 |
| 101 | 8.14 | 5.51 | 1.32 | 1.93 | 5.79 |
| 102 | 3.55 | 0.71 | 3.28 | 1.38 | 2.21 |
| 103 | 1.03 | 1.04 | 0.23 | 0.46 | 1.27 |
| 104 | 1.94 | 1.77 | 2.96 | 0.45 | 1.23 |
| 105 | 0.84 | 4.37 | 1.24 | 10.94 | 2.54 |
| 106 | 3.85 | 1.26 | 1.22 | 1.46 | 4.02 |
| 107 | 0.55 | 1.48 | 0.23 | 2.02 | 0.55 |
| 108 | 13.09 | 5.44 | 12.86 | 10.03 | 9.83 |
| 109 | 0.46 | 0.99 | 0.23 | 1.4 | 0.6 |
| 110 | 1.69 | 0.53 | 1.65 | 0.63 | 2.02 |
| 111 | 100 | 55.59 | 21.9 | 20.06 | 31.75 |
| 112 | 7.58 | 0.88 | 3.14 | 2.71 | 5.91 |
| 113 | 10.18 | 1.45 | 1.2 | 2.27 | 2.28 |
| 114 | 0.83 | 2.12 | 0.84 | 0.91 | 1.88 |
| 115 | 0.68 | 3.24 | 0.73 | 0.45 | 1.72 |
| 116 | 0.13 | 0.16 | 0.31 | 0.21 | 0.19 |
| 117 | 0.16 | 0.25 | 0.04 | 0.14 | 0.19 |
| 118 | 1.54 | 5.34 | 1.44 | 2.49 | 8.18 |
| 119 | 2.29 | 9.38 | 1.64 | 3.99 | 5.71 |
| 120 | 1.44 | 0.71 | 1.79 | 1.72 | 1.02 |
| 121 | 0.93 | 10.46 | 3.24 | 3.7 | 3.8 |
| 122 | 3.02 | 2 | 3.53 | 1.81 | 1.96 |
| 123 | 1.41 | 1.73 | 0.88 | 1.26 | 2.14 |
| 124 | 1.26 | 3.15 | 1.03 | 2.47 | 2.45 |
| 125 | 5.8 | 3.68 | 97.35 | 13.8 | 38.7 |
| 126 | 1.85 | 4.62 | 1.31 | 11.14 | 1.84 |
| 127 | 1.6 | 0.41 | 1.6 | 0.61 | 1.27 |
| 128 | 0.54 | 0.27 | 0.54 | 0.48 | 0.87 |
| 129 | 3.73 | 1.2 | 0.59 | 1.32 | 3.13 |
| 130 | 9.09 | 5.52 | 7.44 | 3.59 | 33.96 |
| 131 | 16.21 | 1.74 | 3.66 | 2.67 | 2.72 |
| 132 | 3.39 | 30.92 | 0.45 | 2.29 | 3.56 |
| 133 | 3.29 | 1.91 | 1.1 | 0.56 | 0.85 |

TABLE 9C-continued

| Testing: Good (G) and Poor (P) (3rd and 4th Bars of FIG. 7A) | | | | | |
|---|---|---|---|---|---|
| 134 | 3.23 | 0.86 | 0.52 | 0.64 | 2.86 |
| 135 | 0.5 | 0.75 | 0.27 | 0.36 | 1.07 |
| 136 | 0.39 | 0.63 | 2.32 | 0.38 | 0.43 |
| 137 | 0.21 | 0.15 | 0.15 | 0.58 | 0.13 |
| 138 | 2.91 | 8.66 | 1.14 | 1.96 | 1.3 |
| 139 | 0.31 | 0.32 | 0.2 | 0.17 | 1.01 |
| 140 | 9.91 | 10.64 | 24.58 | 96.28 | 31.16 |
| 141 | 1.91 | 1.2 | 1.57 | 0.77 | 1.81 |
| 142 | 2.69 | 1.4 | 2.21 | 2.71 | 2.01 |
| 143 | 11.62 | 7.59 | 31.52 | 6.82 | 3.61 |
| 144 | 0.94 | 1.58 | 0.31 | 2.97 | 1.03 |
| 145 | 0.03 | 0.51 | 0.06 | 1.99 | 0.18 |
| 146 | 24.92 | 1.4 | 1.12 | 3.92 | 8.22 |
| 147 | 0.35 | 0.81 | 1.77 | 1.22 | 0.63 |
| 148 | 1.07 | 15.95 | 1.72 | 9.18 | 2.12 |
| 149 | 7.48 | 0.96 | 8.99 | 3.41 | 3.44 |
| 150 | 2.47 | 0.11 | 0.51 | 0.66 | 1.19 |
| 151 | 9.74 | 1.61 | 1.07 | 4.04 | 1.41 |
| 152 | 1.02 | 1.08 | 1.19 | 1.06 | 1.04 |
| 153 | 1.24 | 0.98 | 0.7 | 2.77 | 0.7 |
| 154 | 8.2 | 12.15 | 2.99 | 29.23 | 8.11 |
| 155 | 0.21 | 1.67 | 0.17 | 4.86 | 0.49 |
| 156 | 5.85 | 4.41 | 1.68 | 1.58 | 0.85 |
| 157 | 1.35 | 0.08 | 0.53 | 0.37 | 0.59 |
| 158 | 0.55 | 0.67 | 1.42 | 1.01 | 0.62 |
| 159 | 0.84 | 0.12 | 0.53 | 0.43 | 0.62 |
| 160 | 0.49 | 0.02 | 0.42 | 0.17 | 0.51 |
| 161 | 0.47 | 4.11 | 1.15 | 1.17 | 0.69 |
| 162 | 13.13 | 5.07 | 4.58 | 4.16 | 4.92 |
| 163 | 48.95 | 38.44 | 12.47 | 21.95 | 32.02 |
| 164 | 1.48 | 3.77 | 1.6 | 3.32 | 2.73 |
| 165 | 0.05 | 0.36 | 0.11 | 0.25 | 0.14 |
| 166 | 2.81 | 7 | 3.28 | 2.16 | 10.99 |
| 167 | 100 | 33.6 | 41.57 | 95.82 | 98.54 |
| 168 | 0.12 | 0.25 | 0.21 | 6.7 | 0.16 |
| 169 | 0.01 | 0.01 | 0.02 | 0.01 | 0.02 |
| 170 | 35.03 | 2.4 | 2.95 | 2.76 | 15.91 |
| 171 | 3.04 | 12.32 | 3.57 | 16.48 | 3.39 |
| 172 | 0.47 | 0.54 | 0.58 | 0.23 | 0.23 |
| 173 | 2.32 | 2.18 | 0.96 | 3.94 | 4.67 |
| 174 | 0.74 | 0.96 | 1.28 | 1.35 | 0.88 |
| 175 | 1.47 | 2.41 | 2.3 | 1.29 | 1.24 |
| 176 | 0.89 | 8.87 | 8.49 | 1.14 | 0.55 |
| 177 | 2.54 | 0.7 | 0.8 | 0.72 | 1.08 |
| 178 | 1.21 | 3.81 | 0.67 | 5.52 | 1.6 |
| 179 | 1.75 | 2.25 | 0.44 | 1.13 | 0.19 |
| 180 | 0.12 | 0.81 | 0.15 | 1.34 | 0.23 |
| 181 | 1.28 | 1.26 | 0.53 | 1.04 | 1.49 |
| 182 | 2.83 | 1.6 | 0.91 | 1.27 | 5.41 |
| 183 | 3.41 | 6.72 | 2.14 | 6.59 | 2.65 |
| 184 | 3.43 | 7.67 | 1.35 | 2.24 | 3.64 |
| 185 | 1.07 | 0.07 | 1.21 | 0.56 | 1.06 |
| 186 | 8.61 | 4.69 | 14.19 | 6.51 | 19.85 |
| 187 | 100 | 66 | 86.39 | 36.93 | 85.31 |
| 188 | 0.73 | 3.9 | 0.5 | 5.01 | 1.19 |
| 189 | 0.85 | 0.03 | 0.68 | 0.31 | 0.59 |
| 190 | 1.07 | 26.78 | 1.21 | 4.64 | 1.3 |
| 191 | 0.12 | 2.33 | 1.47 | 0.89 | 0.7 |
| 192 | 1.37 | 0.63 | 0.75 | 0.44 | 0.55 |
| 193 | 4.85 | 3.1 | 6.81 | 2.19 | 5.27 |
| 194 | 0.2 | 0.33 | 0.28 | 0.41 | 0.29 |
| 195 | 1.07 | 2.36 | 1.22 | 1.97 | 5.09 |
| 196 | 0.53 | 4.67 | 0.41 | 1.92 | 0.57 |
| 197 | 21.96 | 5.14 | 1.44 | 5.56 | 7.86 |
| 198 | 1.99 | 2.09 | 0.4 | 1.11 | 0.6 |
| 199 | 0.73 | 1.06 | 0.71 | 1.31 | 2.88 |
| 200 | 0.04 | 0.35 | 0.13 | 0.26 | 0.14 |
| 201 | 0.11 | 0.36 | 0.18 | 0.32 | 0.13 |
| 202 | 0.18 | 0.38 | 0.27 | 4.58 | 0.31 |
| 203 | 0.89 | 0.3 | 3 | 0.16 | 1.87 |
| 204 | 1.51 | 0.69 | 1.1 | 1.16 | 1.55 |
| 205 | 0.36 | 0.97 | 1.06 | 0.57 | 0.55 |
| 206 | 0.7 | 0.33 | 0.77 | 0.31 | 0.95 |
| 207 | 24.9 | 1.39 | 14.41 | 1.43 | 4.8 |
| 208 | 25.57 | 4.81 | 4.44 | 3.84 | 3.91 |
| 209 | 0.43 | 0.05 | 0.29 | 0.16 | 0.21 |
| 210 | 2.6 | 0.97 | 0.72 | 0.85 | 2 |
| 211 | 2.78 | 0.48 | 0.76 | 0.43 | 0.7 |

TABLE 9C-continued

Testing: Good (G) and Poor (P) (3rd and 4th Bars of FIG. 7A)

| | | | | | |
|---|---|---|---|---|---|
| 212 | 49.9 | 2.99 | 8.37 | 15.05 | 17.32 |
| 213 | 0.04 | 0.44 | 0.18 | 0.22 | 0.18 |
| 214 | 0.36 | 1.78 | 0.5 | 0.89 | 0.84 |
| 215 | 0.85 | 0.18 | 0.69 | 2.1 | 0.71 |
| 216 | 0.8 | 1.52 | 0.78 | 7.13 | 1.25 |
| 217 | 2.02 | 1.61 | 1.53 | 1.44 | 2.14 |
| 218 | 1.71 | 1.61 | 0.96 | 1.22 | 1.12 |
| 219 | 2.99 | 1.13 | 0.52 | 0.65 | 1.27 |
| 220 | 0.68 | 0.02 | 0.91 | 0.32 | 0.56 |
| 221 | 2.19 | 1.08 | 0.64 | 0.55 | 1.02 |
| 222 | 0.17 | 1.36 | 0.58 | 1 | 0.37 |
| 223 | 0.99 | 2.68 | 0.6 | 6.16 | 1.49 |
| 224 | 1.11 | 3.67 | 0.96 | 1.38 | 1.13 |
| 225 | 1.42 | 6.11 | 2.67 | 2.86 | 4.17 |
| 226 | 2.08 | 0.87 | 0.22 | 1.3 | 0.62 |
| 227 | 0.46 | 0.42 | 0.87 | 0.85 | 0.64 |
| 228 | 0.61 | 1.01 | 0.48 | 1.56 | 0.37 |
| 229 | 0.45 | 0.86 | 0.18 | 0.48 | 0.87 |
| 230 | 0.37 | 0.11 | 0.32 | 0.13 | 0.16 |
| 231 | 0.14 | 1.03 | 0.16 | 0.57 | 0.14 |
| 232 | 2.61 | 2.39 | 0.88 | 8.27 | 4.68 |
| 233 | 3.55 | 6.69 | 1.07 | 11.5 | 3.3 |
| 234 | 1.51 | 1.6 | 2.4 | 0.81 | 2.33 |
| 235 | 5.31 | 1.85 | 1.04 | 0.73 | 1.67 |
| 236 | 0.38 | 1.3 | 0.84 | 0.7 | 2.26 |
| 237 | 0.27 | 0.33 | 0.3 | 9.71 | 0.62 |
| 238 | 2.62 | 0.73 | 0.5 | 0.55 | 0.54 |
| 239 | 6.77 | 21.43 | 16.53 | 8.37 | 58.27 |
| 240 | 24.05 | 14.02 | 2.2 | 13.72 | 12.74 |
| 241 | 1.22 | 0.13 | 1.54 | 0.36 | 0.77 |
| 242 | 0.88 | 6.25 | 0.7 | 6.12 | 1.21 |
| 243 | 2.6 | 1.32 | 38.02 | 1.5 | 3.16 |
| 244 | 1.22 | 0.24 | 0.23 | 0.73 | 0.52 |
| 245 | 0.85 | 6.95 | 1.32 | 3.16 | 2.33 |
| 246 | 10 | 13.06 | 1.12 | 3.63 | 4.75 |
| 247 | 8.21 | 6.78 | 13.88 | 4 | 12.01 |
| 248 | 3.83 | 2.53 | 1.93 | 1.74 | 1.96 |
| 249 | 9.66 | 3.61 | 2.67 | 7.9 | 11.2 |
| 250 | 1.34 | 0.56 | 2.02 | 0.77 | 1.83 |

| Rank | St3_A_NB72 (P) | St4_A_NB251 (P) | St4_A_NB265 (P) | St4_NA_NB206 (P) | St4_NA_NB8 (P) |
|---|---|---|---|---|---|
| 1 | 6.12 | 1.85 | 0.01 | 0.53 | 3.23 |
| 2 | 4.48 | 2.19 | 1.92 | 1.37 | 2.81 |
| 3 | 24.44 | 7.74 | 1.71 | 14.04 | 8.07 |
| 4 | 0.6 | 0.67 | 0.54 | 4.37 | 0.88 |
| 5 | 13.97 | 1.53 | 7.01 | 18.41 | 3.45 |
| 6 | 53.61 | 18.75 | 31.16 | 56.99 | 20.18 |
| 7 | 1.54 | 3.77 | 0.78 | 1.43 | 1.98 |
| 8 | 7.93 | 0.93 | 2.04 | 0.32 | 1.2 |
| 9 | 0.07 | 0.15 | 0.08 | 0.34 | 0.29 |
| 10 | 0.5 | 0.34 | 0.33 | 0.43 | 0.38 |
| 11 | 6.63 | 1.41 | 0.1 | 0.66 | 4.49 |
| 12 | 0.2 | 2.17 | 1.24 | 2.7 | 1.8 |
| 13 | 0.65 | 0.41 | 0.33 | 0.13 | 0.07 |
| 14 | 1.74 | 2.49 | 0.68 | 0.91 | 6.57 |
| 15 | 0.27 | 0.32 | 0.3 | 0.35 | 0.28 |
| 16 | 69.76 | 28.82 | 56.04 | 1.94 | 1.15 |
| 17 | 2.16 | 1.84 | 4 | 2.35 | 1.57 |
| 18 | 0.6 | 0.35 | 0.4 | 0.1 | 0.2 |
| 19 | 0.06 | 0.26 | 0.11 | 0.06 | 0.04 |
| 20 | 20.79 | 15.87 | 10.85 | 5.09 | 1.93 |
| 21 | 4.69 | 4.58 | 7 | 23.79 | 25.26 |
| 22 | 0.88 | 0.14 | 0.15 | 0.12 | 0.32 |
| 23 | 0.18 | 0.15 | 0.11 | 0.25 | 0.9 |
| 24 | 2.72 | 2.23 | 1.72 | 1.5 | 6.93 |
| 25 | 0.76 | 5.23 | 3.37 | 6.01 | 2.9 |
| 26 | 57.13 | 42.82 | 12.99 | 18.93 | 3.08 |
| 27 | 0.11 | 0.17 | 0.22 | 0.12 | 0.06 |
| 28 | 3.86 | 1.4 | 1.8 | 3.57 | 1.04 |
| 29 | 0.05 | 0.3 | 0.06 | 0.21 | 0.11 |
| 30 | 0.05 | 0.11 | 0.05 | 0.35 | 0.12 |
| 31 | 8.15 | 8.53 | 0.17 | 0.07 | 0.03 |
| 32 | 17.9 | 37.18 | 1.41 | 10.63 | 26.36 |
| 33 | 5.01 | 4.29 | 1.55 | 7.2 | 3.47 |
| 34 | 0.15 | 0.24 | 0.46 | 0.13 | 0.16 |
| 35 | 2.94 | 1.25 | 2.09 | 11.48 | 8.57 |

TABLE 9C-continued

| Testing: Good (G) and Poor (P) (3rd and 4th Bars of FIG. 7A) | | | | | |
|---|---|---|---|---|---|
| 36 | 1.2 | 0.69 | 0.65 | 1.38 | 2.59 |
| 37 | 0.39 | 0.37 | 0.45 | 0.59 | 0.44 |
| 38 | 0.04 | 2.35 | 3.45 | 0.32 | 4.05 |
| 39 | 1.51 | 0.48 | 0.48 | 16.94 | 2.8 |
| 40 | 27.79 | 42.02 | 4.65 | 4.14 | 15.75 |
| 41 | 12.91 | 5.78 | 1.28 | 5.26 | 4.15 |
| 42 | 62.07 | 3.71 | 3.04 | 1.36 | 1.48 |
| 43 | 5.36 | 0.35 | 2.78 | 3.81 | 4.8 |
| 44 | 5.75 | 1.18 | 3.64 | 0.48 | 0.61 |
| 45 | 0.6 | 0.45 | 0.28 | 0.17 | 0.53 |
| 46 | 0.39 | 0.95 | 0.69 | 0.85 | 0.63 |
| 47 | 0.06 | 0.11 | 0.07 | 0.48 | 0.1 |
| 48 | 0.08 | 0.15 | 0.16 | 0.42 | 0.24 |
| 49 | 0.07 | 0.25 | 0.08 | 0.48 | 0.23 |
| 50 | 1.14 | 0.4 | 0.61 | 0.25 | 0.55 |
| 51 | 0.53 | 0.45 | 0.47 | 1.89 | 0.55 |
| 52 | 0.44 | 0.3 | 0.35 | 10.52 | 4.35 |
| 53 | 0.78 | 10.03 | 1.01 | 1.02 | 1.01 |
| 54 | 25.53 | 1.48 | 1.38 | 0.99 | 0.81 |
| 55 | 0.15 | 0.41 | 0.25 | 1.79 | 1.03 |
| 56 | 4.5 | 1.38 | 3.85 | 0.7 | 0.54 |
| 57 | 1.47 | 0.88 | 0.54 | 2.49 | 0.92 |
| 58 | 1.09 | 1.66 | 0.67 | 9.37 | 2.99 |
| 59 | 1.92 | 1.14 | 1.84 | 0.73 | 1.12 |
| 60 | 28.97 | 9.81 | 21.36 | 40.22 | 19.11 |
| 61 | 29.51 | 9.88 | 19.02 | 43.8 | 21.99 |
| 62 | 0.42 | 0.39 | 0.8 | 1.06 | 0.42 |
| 63 | 0.68 | 4.89 | 1.44 | 2.49 | 0.66 |
| 64 | 0.94 | 2.14 | 1.34 | 2.19 | 0.72 |
| 65 | 2.07 | 1.94 | 1.42 | 2.54 | 2.2 |
| 66 | 2.01 | 1.81 | 1.03 | 0.79 | 2.24 |
| 67 | 2.02 | 3.65 | 4.51 | 0.78 | 0.82 |
| 68 | 0.61 | 1.84 | 0.42 | 0.41 | 0.34 |
| 69 | 4.44 | 12.72 | 22.49 | 2.72 | 1 |
| 70 | 0.03 | 0.04 | 0.02 | 0.04 | 0.05 |
| 71 | 0.9 | 1.99 | 0.67 | 1.85 | 1.73 |
| 72 | 3.34 | 6.63 | 22.25 | 3.41 | 0.78 |
| 73 | 20.49 | 55.43 | 100 | 20.04 | 100 |
| 74 | 0.44 | 0.57 | 0.33 | 0.4 | 0.49 |
| 75 | 0.72 | 1.18 | 1.99 | 1.1 | 0.93 |
| 76 | 0.57 | 4.27 | 1.17 | 1.98 | 0.72 |
| 77 | 3.28 | 4.93 | 1.82 | 2.15 | 6 |
| 78 | 3.32 | 2.03 | 3.01 | 14.62 | 8.46 |
| 79 | 3.25 | 5.65 | 7.18 | 2.2 | 1.38 |
| 80 | 0.74 | 0.92 | 0.57 | 2.57 | 10.37 |
| 81 | 68.76 | 14.62 | 13.89 | 13.34 | 18.47 |
| 82 | 0.15 | 0.2 | 0.1 | 0.13 | 0.08 |
| 83 | 7.63 | 2.81 | 6.07 | 0.62 | 0.4 |
| 84 | 0.49 | 0.82 | 0.5 | 0.59 | 0.48 |
| 85 | 0.18 | 1.96 | 2.47 | 0.42 | 3.13 |
| 86 | 0.11 | 3.84 | 1.78 | 0.25 | 0.33 |
| 87 | 0.54 | 0.85 | 0.83 | 0.33 | 0.63 |
| 88 | 2.53 | 1.21 | 0.93 | 0.97 | 1.75 |
| 89 | 0.06 | 0.29 | 0.14 | 0.11 | 0.1 |
| 90 | 2.46 | 0.97 | 1.04 | 0.16 | 1.17 |
| 91 | 5.83 | 3.26 | 1.84 | 1.22 | 5.14 |
| 92 | 0.61 | 0.33 | 3.3 | 0.16 | 1.21 |
| 93 | 0.12 | 0.16 | 0.37 | 0.84 | 0.64 |
| 94 | 1.99 | 1.37 | 2.01 | 0.32 | 0.58 |
| 95 | 0.66 | 3.05 | 1.93 | 2.14 | 1.82 |
| 96 | 0.06 | 0.11 | 0.09 | 0.1 | 0.22 |
| 97 | 0.55 | 0.37 | 0.36 | 0.57 | 0.44 |
| 98 | 0.72 | 0.85 | 0.8 | 1.04 | 0.32 |
| 99 | 0.08 | 0.1 | 0.06 | 0.33 | 0.08 |
| 100 | 6.9 | 8.02 | 7.73 | 2.73 | 2.82 |
| 101 | 1.8 | 2.28 | 1.56 | 2.01 | 1.52 |
| 102 | 3.44 | 1.17 | 3.25 | 0.82 | 0.59 |
| 103 | 0.34 | 0.53 | 0.27 | 1.27 | 0.72 |
| 104 | 0.29 | 0.72 | 0.12 | 0.91 | 0.61 |
| 105 | 0.67 | 5.55 | 4.38 | 2.26 | 2.71 |
| 106 | 12.85 | 7.64 | 3.89 | 3.22 | 10.44 |
| 107 | 0.32 | 1.41 | 1.65 | 0.58 | 1.27 |
| 108 | 1.71 | 7.3 | 2.1 | 5.85 | 4.57 |
| 109 | 0.15 | 1.77 | 1.19 | 0.3 | 1.35 |
| 110 | 0.75 | 0.87 | 1.75 | 0.35 | 0.54 |
| 111 | 53.27 | 14.05 | 20.21 | 39.19 | 74.58 |
| 112 | 1.22 | 7.62 | 3.38 | 1.44 | 0.84 |
| 113 | 1.14 | 2.47 | 1 | 1.58 | 0.92 |

TABLE 9C-continued

| Testing: Good (G) and Poor (P) (3rd and 4th Bars of FIG. 7A) | | | | | |
|---|---|---|---|---|---|
| 114 | 2.23 | 4.52 | 1.21 | 4.57 | 2.74 |
| 115 | 0.41 | 0.5 | 0.47 | 2.65 | 0.57 |
| 116 | 1.08 | 0.43 | 1.66 | 0.35 | 0.23 |
| 117 | 0.06 | 0.09 | 0.06 | 0.29 | 0.09 |
| 118 | 2.6 | 2.76 | 3.95 | 1.38 | 1.07 |
| 119 | 1.02 | 1.71 | 1.51 | 6.18 | 2.81 |
| 120 | 8.41 | 1.53 | 2.28 | 0.65 | 4.13 |
| 121 | 2.43 | 0.46 | 2.07 | 16.71 | 7.86 |
| 122 | 0.74 | 0.97 | 0.77 | 1.22 | 1.51 |
| 123 | 0.92 | 0.79 | 0.98 | 0.91 | 0.8 |
| 124 | 0.69 | 1.42 | 0.82 | 0.52 | 0.64 |
| 125 | 12.62 | 2.87 | 1.48 | 19.56 | 2 |
| 126 | 16.29 | 5.28 | 13.4 | 4.66 | 18.42 |
| 127 | 0.98 | 0.65 | 1.59 | 0.42 | 0.48 |
| 128 | 0.22 | 0.61 | 0.34 | 0.39 | 0.15 |
| 129 | 0.5 | 1.64 | 0.62 | 0.57 | 1.33 |
| 130 | 1.56 | 10.96 | 2.82 | 14.97 | 22.42 |
| 131 | 1.01 | 3.14 | 1.85 | 1.26 | 1.4 |
| 132 | 1.8 | 1.31 | 0.37 | 8.81 | 2.43 |
| 133 | 0.91 | 0.86 | 4.48 | 0.86 | 0.67 |
| 134 | 0.65 | 1.36 | 1.61 | 0.55 | 0.55 |
| 135 | 0.3 | 0.37 | 0.26 | 0.3 | 0.41 |
| 136 | 0.56 | 0.48 | 1.55 | 0.63 | 5.95 |
| 137 | 0.04 | 1.78 | 0.75 | 0.1 | 0.15 |
| 138 | 8.45 | 2.49 | 1.37 | 11.99 | 10.61 |
| 139 | 0.29 | 0.21 | 0.21 | 0.33 | 0.34 |
| 140 | 6.41 | 15.05 | 33.73 | 27.39 | 67.51 |
| 141 | 0.51 | 0.47 | 0.89 | 1.19 | 0.38 |
| 142 | 10.87 | 2.88 | 1.55 | 2.28 | 2.46 |
| 143 | 5.95 | 11.88 | 3.16 | 19.58 | 20.7 |
| 144 | 0.29 | 2.04 | 1.57 | 0.41 | 0.37 |
| 145 | 0.06 | 3.82 | 1.27 | 0.03 | 0.08 |
| 146 | 2.9 | 2.53 | 1.49 | 1.49 | 1.77 |
| 147 | 1.71 | 0.63 | 1.59 | 2.12 | 0.88 |
| 148 | 7.58 | 1.3 | 3.98 | 7.98 | 9.19 |
| 149 | 2.45 | 2.11 | 1.47 | 0.87 | 1.35 |
| 150 | 1.8 | 1.25 | 2.18 | 0.19 | 0.61 |
| 151 | 1.78 | 2.59 | 1.27 | 1.27 | 0.77 |
| 152 | 7.3 | 6.7 | 4.8 | 1.64 | 0.8 |
| 153 | 0.24 | 8.66 | 3.7 | 0.34 | 0.33 |
| 154 | 1.3 | 58.96 | 20.73 | 1.91 | 3.82 |
| 155 | 0.18 | 10.07 | 2.48 | 0.2 | 0.26 |
| 156 | 0.89 | 1.27 | 0.84 | 2.04 | 0.78 |
| 157 | 1.27 | 0.78 | 1.67 | 0.15 | 0.61 |
| 158 | 1.75 | 0.59 | 0.79 | 1.58 | 1.71 |
| 159 | 0.8 | 0.81 | 1.08 | 0.13 | 0.58 |
| 160 | 1.01 | 0.63 | 0.62 | 0.09 | 0.52 |
| 161 | 0.37 | 0.99 | 0.68 | 0.35 | 0.46 |
| 162 | 1.61 | 2.13 | 2.5 | 1.37 | 2.43 |
| 163 | 21.61 | 26.34 | 4.8 | 100 | 49.1 |
| 164 | 1.18 | 1.04 | 0.94 | 4.55 | 1.33 |
| 165 | 0.06 | 0.12 | 0.11 | 0.12 | 0.07 |
| 166 | 1.38 | 1.25 | 1.93 | 1.43 | 2.03 |
| 167 | 100 | 35.46 | 100 | 22.55 | 100 |
| 168 | 3.83 | 9.58 | 0.19 | 0.22 | 0.13 |
| 169 | 0.01 | 0.03 | 0.01 | 0.02 | 0.01 |
| 170 | 5.02 | 5.48 | 1.73 | 3.13 | 2.37 |
| 171 | 1.45 | 5.38 | 9.05 | 2.61 | 9.69 |
| 172 | 2.38 | 0.18 | 4.76 | 0.46 | 0.29 |
| 173 | 0.69 | 3.4 | 3.07 | 2.7 | 2.53 |
| 174 | 3.1 | 2.71 | 3.02 | 1.36 | 0.87 |
| 175 | 5.32 | 3.56 | 1.19 | 2.73 | 2.55 |
| 176 | 0.78 | 1.09 | 1.77 | 0.74 | 0.6 |
| 177 | 0.93 | 1.64 | 1.14 | 0.54 | 0.84 |
| 178 | 0.54 | 3.51 | 3.3 | 1.26 | 2.53 |
| 179 | 0.22 | 0.78 | 0.95 | 0.38 | 0.73 |
| 180 | 0.13 | 0.48 | 0.44 | 0.49 | 0.63 |
| 181 | 0.35 | 0.47 | 0.46 | 0.33 | 0.42 |
| 182 | 1.26 | 1.53 | 0.65 | 1.33 | 1.16 |
| 183 | 6.17 | 2.25 | 9.77 | 2.49 | 2.87 |
| 184 | 1.58 | 2.83 | 0.92 | 5.5 | 2.04 |
| 185 | 1.8 | 0.98 | 2.56 | 0.31 | 1.14 |
| 186 | 23.26 | 12.34 | 20.21 | 13.28 | 11.55 |
| 187 | 86.73 | 19.69 | 20.09 | 100 | 82.21 |
| 188 | 0.36 | 3.59 | 2.93 | 1.23 | 1.74 |
| 189 | 0.93 | 0.68 | 0.61 | 0.07 | 0.42 |
| 190 | 1.48 | 2.07 | 2.53 | 7.18 | 2.74 |
| 191 | 2.45 | 2.08 | 0.31 | 0.65 | 2.32 |

TABLE 9C-continued

Testing: Good (G) and Poor (P) (3rd and 4th Bars of FIG. 7A)

| | | | | | |
|---|---|---|---|---|---|
| 192 | 0.3 | 0.33 | 0.36 | 0.3 | 0.45 |
| 193 | 0.89 | 1.16 | 0.81 | 2.02 | 1.87 |
| 194 | 3.21 | 0.9 | 0.35 | 0.51 | 2.15 |
| 195 | 0.82 | 1.1 | 1.97 | 1.18 | 1 |
| 196 | 0.25 | 0.79 | 0.41 | 0.91 | 0.39 |
| 197 | 3.15 | 4.59 | 3.46 | 3.85 | 3.07 |
| 198 | 2.29 | 1.63 | 1.74 | 0.59 | 0.78 |
| 199 | 0.55 | 0.3 | 0.43 | 3.58 | 2.83 |
| 200 | 0.07 | 0.12 | 0.11 | 0.13 | 0.07 |
| 201 | 1.38 | 0.31 | 1.3 | 0.26 | 0.2 |
| 202 | 3.62 | 6.16 | 0.28 | 0.3 | 0.24 |
| 203 | 6.01 | 2.5 | 6.24 | 0.39 | 2.17 |
| 204 | 3.96 | 1.7 | 1.6 | 1.22 | 1.65 |
| 205 | 1.63 | 0.73 | 1.19 | 1.44 | 2.28 |
| 206 | 0.5 | 0.71 | 0.81 | 0.17 | 1.79 |
| 207 | 4.26 | 10 | 5.13 | 1.16 | 0.44 |
| 208 | 4.78 | 10.51 | 3.17 | 2.11 | 2.69 |
| 209 | 1.02 | 0.44 | 0.47 | 0.1 | 0.4 |
| 210 | 0.6 | 0.81 | 0.46 | 0.83 | 1.22 |
| 211 | 0.9 | 2.42 | 4.94 | 0.53 | 1.42 |
| 212 | 22.47 | 2.61 | 44.62 | 7.92 | 1.79 |
| 213 | 0.08 | 0.12 | 0.08 | 0.3 | 0.09 |
| 214 | 2.28 | 1.28 | 0.65 | 3.38 | 2.92 |
| 215 | 0.75 | 1.24 | 2.56 | 0.47 | 1.93 |
| 216 | 0.6 | 1.01 | 0.88 | 0.85 | 2.6 |
| 217 | 0.92 | 0.9 | 0.91 | 2.42 | 0.87 |
| 218 | 0.71 | 0.8 | 1.52 | 1.37 | 1.3 |
| 219 | 1.04 | 0.38 | 1.22 | 0.57 | 0.2 |
| 220 | 1.61 | 0.5 | 0.94 | 0.04 | 0.42 |
| 221 | 0.59 | 0.64 | 2.26 | 0.32 | 0.55 |
| 222 | 0.51 | 0.53 | 0.43 | 0.84 | 0.7 |
| 223 | 0.17 | 0.8 | 0.58 | 1.82 | 1.15 |
| 224 | 12.33 | 2.46 | 9.33 | 2.29 | 1.04 |
| 225 | 2.4 | 2.72 | 2.19 | 9.43 | 2.79 |
| 226 | 3.35 | 2.81 | 1.5 | 1.08 | 3.83 |
| 227 | 0.43 | 0.25 | 0.2 | 1.21 | 0.37 |
| 228 | 0.44 | 0.56 | 0.6 | 0.51 | 0.56 |
| 229 | 0.17 | 0.18 | 0.14 | 0.42 | 0.37 |
| 230 | 0.37 | 0.21 | 0.29 | 0.17 | 0.26 |
| 231 | 0.08 | 0.38 | 0.28 | 0.28 | 0.3 |
| 232 | 1.53 | 2.66 | 3.8 | 7 | 7.15 |
| 233 | 1.23 | 5.16 | 1.9 | 1.11 | 3.02 |
| 234 | 4.91 | 3.02 | 1.69 | 2.94 | 3.62 |
| 235 | 7.27 | 3.11 | 3.89 | 2.43 | 3.07 |
| 236 | 0.4 | 0.64 | 0.74 | 0.64 | 0.55 |
| 237 | 6.43 | 14.77 | 0.6 | 0.36 | 0.28 |
| 238 | 0.24 | 0.78 | 0.74 | 0.67 | 1.12 |
| 239 | 4.92 | 3.66 | 9.47 | 3.99 | 6.04 |
| 240 | 12.26 | 15.44 | 10.9 | 4.82 | 9.11 |
| 241 | 2.02 | 0.67 | 1.08 | 0.32 | 0.58 |
| 242 | 0.56 | 2.97 | 2.74 | 1.55 | 2.02 |
| 243 | 0.75 | 1.66 | 1.32 | 1.07 | 0.75 |
| 244 | 0.28 | 0.33 | 0.12 | 0.24 | 0.44 |
| 245 | 0.65 | 3.29 | 3.96 | 3.48 | 3.54 |
| 246 | 2.16 | 1.28 | 0.97 | 2.53 | 4.02 |
| 247 | 11.2 | 6.51 | 7.83 | 20.66 | 10.96 |
| 248 | 1.02 | 0.97 | 0.78 | 0.95 | 0.68 |
| 249 | 6.68 | 6.84 | 15.39 | 2.28 | 12.63 |
| 250 | 0.79 | 0.7 | 1.54 | 1.05 | 0.49 |

For the gene minimization procedure the 7 replicate samples were placed in the training set and the remaining samples were then randomly partitioned into training (n=35) and testing (n=21) sets (FIG. 4B). The minimal number of clones for outcome prediction was identified using the training set as described above. Quality-filtered clones were first ranked by determining the sensitivity of prediction of the 35 training samples with respect to a change in the gene expression level of each clone. Then, using increasing numbers of the top ANN-ranked clones, the minimum number of clones that generated minimum prediction errors were identified (FIG. 4B). Where multiple clones represented one gene, the top-ranked clone was selected to obtain a minimal predictor gene set. The ANNs were then recalibrated using the expression ratios of these genes for the training samples (without performing principal component analysis (PCA)). Finally the survival status of the test samples was predicted using the trained ANNs (FIG. 4B). It was also determined that the top 250 ranked genes would provide a classification error less than about 2/35. These top 250 ranked genes are given in Table 3.

Example 5

Outcome Prediction for High-Risk Patients

This example shows that the gene expression signatures for both the full set of genes and the minimized gene set can separate those patients currently stratified as high-risk according to their survival status.

Figure 8A:
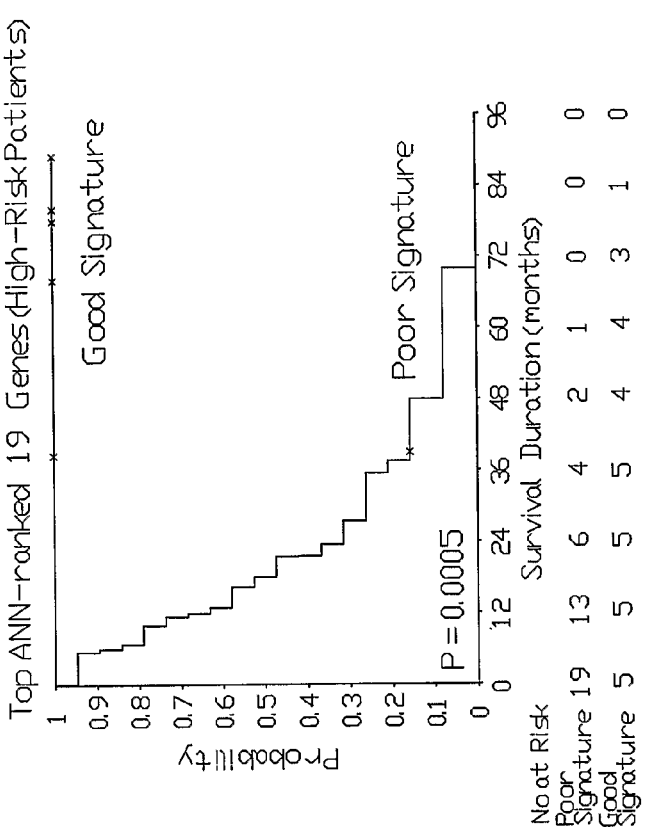
FIGS. 8A, B, C, D, E, and F depict (A) Kaplan-Meier curves of survival probability for all 37920 genes; (B) Kaplan-Meier curves of the top 19 ANN-ranked genes; (C) Multivariate Cox Proportional Hazards Models excluding the ANN prediction—H.R.=hazard ratio. C.I.=confidence interval; (D) Multivariate Cox Proportional Hazards Models based on MYCN status, all 37920 clones ANN prediction; (E) Kaplan-Meier curves for survival probability of the high-risk patients (n=24) based on both MYCN status (top solid line represents MYCNamplified and good outcome; the solid line ending at 36 months represents MYCNamplified and poor outcome; top dotted line represents MYCN nonamplified and good outcome; bottom dotted line ending at 72 months represents MYCN nonamplified and poor outcome) and the 37920 clones ANN prediction; and (F) Kaplan-Meier curves for survival probability of the MYCN non-amplified high-risk patients (n=24) using the predictions based on the top 19 genes.
Figure 8B:
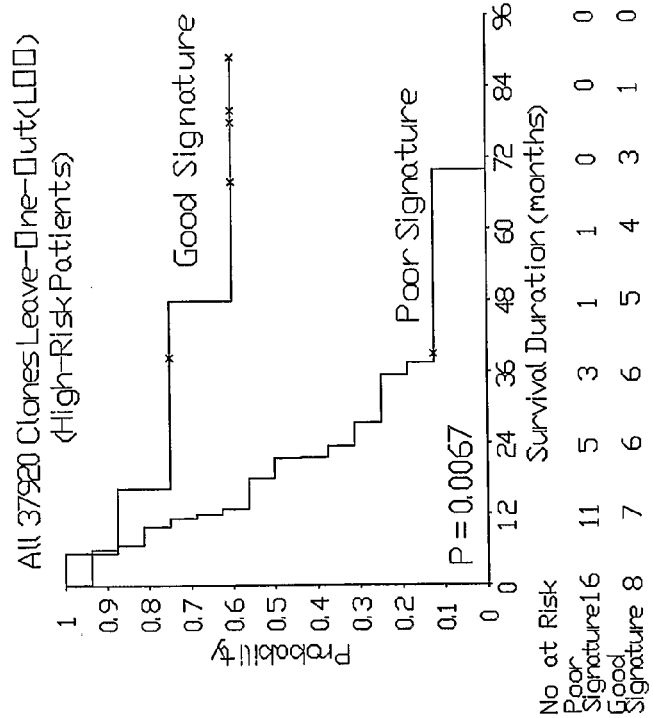

For the 24 high-risk patients in examples 3 and 4, the Kaplan-Meier curves demonstrated that ANNs were able to further partition these patients according to their clinical outcomes using all 37920 quality-filtered clones (P=0.0067), as well as the top 19 ANN-ranked genes (P=0.0005) (FIGS. 8A and B). As shown in FIG. 8B, the top 19 ANN-ranked genes were able to correctly predict all 5 with good signature as surviving, and 18/19 with poor signature as dying, suggesting a potential benefit for predicting outcome in these high-risk patients. The hazard ratio was again infinite as all of the patients that we predicted to have a good-outcome survived (Table 8).

Figure 8E:
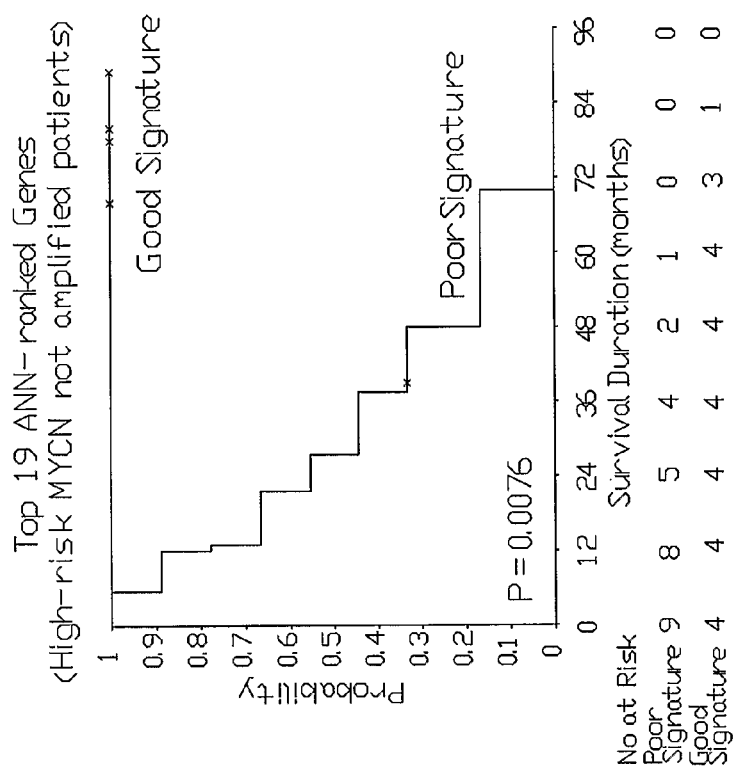
Figure 8F:
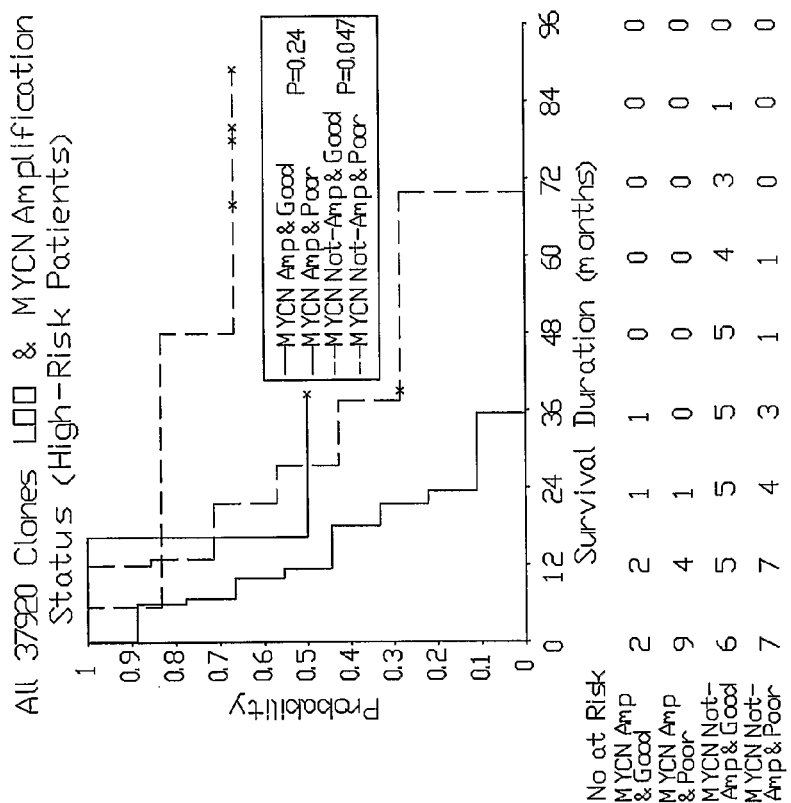

To determine if the gene expression signatures could provide additional predictive power over the conventional risk factors, a Cox model was created using age, stage and MYCN amplification excluding the ANN prediction results. The model showed that MYCN amplification (P=0.0064) was the only significant factor (i.e., P<0.05, see FIG. 8C). Therefore another multivariate model using MYCN amplification was built and the prediction results based on all 37920 clones (FIG. 8D) (the ANN results based on the 37920 clones were used, because there were no deaths in the good signature group using the 19 genes, and in these circumstances it is not possible to create models where the hazard ratios are infinite). Applying the likelihood ratio test, it was determined that prediction by all clones added predictive ability to the model (P=0.012). Additionally, the Kaplan-Meier curves (FIGS. 8E and 7F) illustrate that ANN prediction can further separate the MYCN non-amplified patients according to their survival status based on either all clones (P=0.047) or in particular the 19 genes (P=0.0076 see FIG. 8F).

An ANN-based method for predicting the outcome of patients with NB has been developed that can use the expression profiles of only 19 genes that provides a significant improvement in prediction over the current known risk factors. Moreover, it has been found that the most important advantage of the approach was the ability to further partition COG (Children's Oncology Group) stratified high-risk patients, in particular those without MYCN amplification, into two subgroups according to their survival status. The ability to predict the outcome of individual patients with high-risk NB at initial diagnosis using gene expression signatures has major clinical implications, since approximately 70% of the patients in this group (about 50% of all NB patients) succumb to the disease. Firstly, patients that are identified to have a poor signature, i.e. predicted to die if given conventional therapy, may directly benefit from the newer therapeutic strategy trials that are currently under investigation by the cooperative study groups such as COG. Secondly, since treatment-related death rates have been reported to be as high as 23%, it may be possible to design future dose intensity reduction trials to minimize therapy-related morbidity and mortality for the high-risk patients who have a good signature. An example of such a patient in the latter category is NB14 (stage 4, MYCN-amplified) who despite his high-risk status experienced event free survival for >3 yrs as was predicted by our ANNs. Although the survival rate for patients with COG stratified low-risk disease is 95%, our approach may identify the few patients predicted to have a poor outcome by the ANNs who may benefit from more aggressive therapy. For instance, although case NB18 was classified as low-risk (based on stage 2 and MYCN not amplified), our ANNs predicted this sample as poor-outcome, and this patient died within 1.5 years after diagnosis. These results indicate the potential utility of using the approach for individualized management of patients with cancer Since there was some overlap in the expression levels of the top 19 ANN-ranked genes between the prognostic groups, the prospect of identifying a single gene that can accurately predict outcome is unlikely. Thus, a combinatorial approach using several genes and artificial machine learning algorithms provided for accurate outcome prediction. MYCN amplification is an established marker for high stage and poor outcome, and plays a role in the aggressive phenotype of NB tumors. Our analysis confirmed MYCN as a prognostic marker (ranked 16 out of 19), however, the median expression level of this gene was similar in the two groups, in agreement with previous reports that MYCN expression levels are not consistently correlated with survival in patients with non-amplified tumors. MYCN amplification is currently the only molecular marker utilized for risk stratification, however, it cannot be used as the sole risk predictor, as only 22% of NB patients have this molecular trait.

Of the 19-predictor genes, 8 out of the 12 known genes have been previously reported to be expressed in neural tissue. Of these, 5 were up regulated in the poor-outcome group (DLK1, PRSS3, ARC, SLIT3, and MYCN) and 3 were down regulated (CNR1, ROBO2, and BTBD3). DLK1 (ranked number 1) is the human homologue of the *Drosophilia* delta gene and is expressed by neuroblasts in the developing nervous system as well as in neuroblastoma. It is a transmembrane protein that activates the Notch signaling pathway, which has been shown to inhibit neuronal differentiation. Additionally, ARC, MYCN, and SLIT3 are also expressed during neural development. The higher expression levels of these genes in the poor-outcome tumors suggest a more aggressive phenotype characterized by a less differentiated state, reminiscent of proliferating and migrating neural crest progenitors. Up regulation of the neuron axon repellant gene, SLIT3, was observed with the down regulation of one of its receptors, ROBO2, in the poor-outcome group suggesting the possibility that these neuroblastoma cells secrete a substrate to repel connecting axons and potentially prevent differentiation.

Of additional interest, the ARHI gene, which maps to 1p31, is a maternally imprinted tumor suppressor gene implicated in ovarian and breast cancer, possibly through methylation silencing, and is among the down regulated genes for the poor-outcome group. A further study of its role in tumorigenesis as a potential tumor suppressor gene in NB is warranted particularly because of its proximity to the 1p36 region, which is frequently deleted in poor-outcome NB patients.

We noted the absence of three previously reported prognostic related genes, TRKA, TRKB and FYN, amongst our 19 genes. Unfortunately, TRKA was not on the microarrays, and TRKB and FYN were not ranked within the top 500 clones by ANNs. At this point, the predictive role of TRKA, TRKB or FYN is not conclusive, and none are currently utilized to guide therapy.

In this study a small subset of 19 predictor genes was identified from a pool of 25933 unique genes with the majority of genes showing a greater than two fold average differential expression between good- and poor-outcome tumors. This small number of genes can be provide cost-effective clinical assays for outcome prediction. In addition, the products of 3 genes (DLK1, SLIT3, and PRSS3) are secreted proteins, indicating the utility of these proteins as serum markers for prognosis.

In this data set, our ANN-based method provided a significant improvement in prediction over the current risk factors in patients with NB. Moreover, an advantage of the approach is the ability to further partition COG stratified high-risk patients, in particular those without MYCN amplification, into two subgroups according to their survival status. This approach would allow physicians to tailor therapy for each individual patient according to their molecular profile, with the prospect of improving clinical outcome and survival rates in patients with neuroblastoma.

The above specification, examples and data provide a complete description of the manufacture and use of the composition of the invention. Since many embodiments of the invention can be made without departing from the spirit and scope of the invention, the invention resides in the claims hereinafter appended. All references identified herein are hereby incorporated by reference.

SEQUENCE LISTING (256 sequences)

SEQ ID NO: 1 - DNA, 1547 bp, Homo sapiens
gagagcgcagcgcgcagcccggtgcagccctggctttcccctcgctgcgcgcccgcgccccctttcgcgtccgcaaccagaagcccagtgcggcgccaggagccggacccgcgcccgcaccgctcccgggaccgcgaccccggccgcccagagatgaccgcgaccgaagccctcctgcgcgtcctcttgctcctgctggctttcggccacagcacctatggggctgaatgcttcccggcctgcaacccccaaaatggattctgcgaggatgacaatgtttgcaggtgccagcctggctggcagggtcccctttgtgaccagtgcgtgacctctcccggctgccttcacggactctgtggagaacccgggcagtgcatttgcaccgacggctgggacggggagctctgtgatagagatgttcgggcctgctcctcggccccctgtgccaacaacgggacctgcgtgagcctggacgatggcctctatgaatgctcctgtgcccccgggtactcgggaaaggactgccagaaaaaggacgggccctgtgtgatcaacggctccccctgccagcacggaggcacctgcgtggatgatgagggccgggcctcccatgcctcctgcctgtgcccccctggcttctcaggcaatttctgcgagatcgtggccaacagctgcacccccaacccatgcgagaacgacggcgtctgcactgacatcgggggcgacttccgctgccggtgcccagccggcttcatcgacaagacctgcagccgcccggtgaccaactgcgccagcagcccgtgccagaacgggggcacctgcctgcagcacacccaggtgagctacgagtgtctgtgcaagcccgagttcacaggtctcacctgtgtcaagaagcgcgcgctgagcccccagcaggtcacccgtctgcccaacggctatgggctggcctaccgcctgacccctggggtgcacgagctgccggtgcagcagccggagcaccgcatcctgaaggtgtccatgaaagagctcaacaagaaaacccctctcctcaccgagggccaggccatctgcttcaccatcctgggcgtgctcaccagcctggtggtgctgggcactgtgggtatcgtcttcctcaacaagtgcgagacctgggtgtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttcctcagagcttactatacgcggtctgtcctaatctttgtggtgttcgctatctcttgtgtcaaatctggtgaacgctacgcttacatatattgtctttgtgctgctgtgtgacaaacgcaatgcaaaaacaatcctctttctctctcttaatgcatgatacagaataataataagaatttcatctttaaaaaaaaaaaaaaaaaa

SEQ ID NO: 2 - DNA, 2465 bp, Homo sapiens
ttttgaaatgtcatccatggataatagcttcaattttaggaaagatttaaatgtataactttcctcattcagtgctgtgtcatttcacagtacagatctgcgttaatttttgacagctcatatatacagatttttagaaatgtaatagaaaatgattttgcacatatggtgcaagtcttgctggtgtatgtttaatgtggcaacacgtgccagaactgtttggcaaaacatgtcaaatggagtgcttgagtcagaactctaatgtaaatgtgtctaaacagcagtatgtatcattatgatgtatttttgtaaacatagtgatggctgctttcagtcatgtaagtgctggataaaaataaccacttcagttggagtaatgtaggaaaacgtcacccagcagatgggtagtcctctgcaaagttacactgtcagccagtggcactggttcttttatttatgttgggtttttgttttttttttagaggagagtgaagaattgacatcagacaacatggagtgcaaaaataataacccatcaatatttgccttctaaatgtaaaatgtaaaagtttaactgatctgtgtacacattagagaccactttcacacgccacaatatgttcagttgcaggttaacactgagaggttgagacttccctcatctgatgaccagcttggttaatttgacttctgaaggcactaaattaccaagtatttgcagtaatggggaccggattaattttcctcacaattctctatagctgtctgatataagggctgtgtttttattgaatcacagatcctcaaattacagtgaaagcatgtcttgctagtaagactcatttgaaaacctctttattcttggaataattgggccagtacaagtggccagatgtatcctggccacattggaaaactatttgggcccgttcagagccacttaactgcaacaacagtagtaactatagttaatatctatctattgagttattgtgtgacagttacttggataagtactttaatgcattctcattttaatcctcacagctaccctatgaggctgttactgttcttatccccattgtattgataaggaaactgcccagggtactcagctaagaagaggattgctttgggcataggaagcagaatgacgagttcagtcttcctcagtagttggagcacagttctcaaagcccatcaacactttggaatggatttgttgttttatttatgccatcaagggagagttgatatttgtgtattgctaaaaactactaaagtatgtcgatgcttaggtaggaacatacaaaccatatatcctctgggatctgcccaggtttctgtataaggcttgacctacgtaagatcctatgatgaagaccagaaaactttttttaaaagtaggtaaattaaaattaaaatcacgagtttgttcacatttgtcccataggttcctagtgcaaaaatgcagggagataaaagcaaacatttgaactcagtgaagtgagagtctttgggaactcctagatgttagaaatagcaccggggcatcaggtagccaacgttcaattcacttttcacgtttgtgtctttgtagctttagagctgatgagtctgattggtttggaagagagagttttaatttatgatgtcactgtgagaactgttgtgaaaattttgtaagaaaatacagtaatctgttgattttttcctgtagttttggctttcacatccctttggctgtgtttaagttcaagagcatgccaaggccatgagggtcctggcttgcacttcttgggaacagggcatgctagaggtgggtcatgaagctttcaaggtcactgttccagcccgaccctgcgcaatttaggcattgcctttatgtctctcctctctggaacttcatgtagcagcctaacaccggggccgagttgcctttactctattttctatgatgaatacttgtggagaaactgtgacaaatccattgatcctgatatttttattgttggagtcttgttgattctctatgaataatttctatttgattgtactgtgtagagttaatacccactagggatatgttaataaagctacaaatgcatagtgtaatatagaatagcaagatttttttgtgaacaatttatatagaagagtaagttgttttttaagtgttaggctcatttcttttagaaacttaaaatgttataaaagttttttaaacattcaatatttttaattataagagacatttgttactagagccaattatttcaggtgttctaattggagtgttgattttattacctcatatacctctagaatgccacgtgttctgttggggataaaattgcacgataaatgtcaagtctctgttaagtgttttaacttggtttttgcatctttctaattcattgtaaatacttttctgtttctttgaatacataacttttctctccccg

SEQ ID NO: 3 - DNA, 807 bp, Homo sapiens
acactctaccaccatgaatccattcctgatccttgcctttgtgggagctgctgttgctgtcccctttgacgatgatgacaagattgttgggggctacacctgtgaggagaattctctcccctaccaggtgtccctgaattctggctcccacttctgcggtggctccctcatcagcgaacagtgggtggtatcagcagctcactgctacaagacccgcatccaggtgagactgggagagcacaacatcaaagtcctggaggggaatgagcagttcatcaatgcggccaagatcatccgccaccctaaatacaacagggacactctggacaatgacatcatgctgatcaaactctcctcacctgccgtcatcaatgcccgcgtgtccaccatctctctgcccaccgcccctccagctgctggcactgagtgcctcatctccggctggggcaacactctgagctttggtgctgactacccagacgagctgaagtgcctggatgctccggtgctgacccaggctgagtgtaaagcctcctaccctggaaagattaccaacagcatgttctgtgtgggcttccttgagggaggcaaggattcctgccagcgtgactctggtggccctgtggtctgcaacggacagctccaaggagttgtctcctggggccatggctgtgcctggaagaacaggcctggagtctacaccaaggtctacaactatgtggactggattaaggacaccatcgctgccaacagctaaagcccccggtccctctgcagtctctataccaataaagtggccctgctctc

SEQ ID NO: 4 - DNA, 1495 bp, Homo sapiens
ggggtgtccagttggttgccgcggcagtctctccgagcagcgcatttgtcttctaggctgcttggttcgtgcctccgagaaaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaaaaaaaaaaaaa

SEQ ID NO: 5 - DNA, 327 bp, Homo sapiens
ttttattaacaaaatcttacaaaagagtctgtctctggggtaaggtgcacagggcctggaccgacatttaaggcctggctgtgtggggcaaggggcaggggttggccacagcctcatgaggtttccagggtcttcacaggctccagggcttccccaaagcctgtgccagccttgaggattggttatggcttatgtgcaaaaataaaatctgtggggctggcagggtgtggctgaagacttgtcagagtggtctgcagggctggtcccccagtggacaaggcagaacgatgaaccctgagccagcacctcttaggctcagctcgtgcc

SEQ ID NO: 6 - DNA, 5015 bp, Homo sapiens
gcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgccaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggtttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctccgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaa

SEQ ID NO: 7 - DNA, 5486 bp, Homo sapiens
gattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaaaaaaaaaaaaaa

SEQ ID NO: 8 - DNA, 2118 bp, Homo sapiens
gtggaacagtcttgttatggagtgccagcttagaggttgttgcaaacttgtctagaagtgagagcatggttttttttagccctttgagagtctacatctaatgaacattcttgctcacccataaataacgtcaagcctcaatgtcaccgtcacgttgggatactctttctcatctggcatcctagacaggacaaggttggttacctttccttccatgaaccatgaacctgtgacggcatcattcatcctgacttcaccaagctccgcctgtgggtgaggccagagctcccactggcaatttttagaagagccagaggctccctgcttcctctagaaataacagttcagggtgaagcatggagggtttcagttcccagacaatggaaccatttagagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagcacagagccaggttgtcttgtggaaaccacagccacgggtttgccactggctcagcatggcctcactgccagtcccagcctggctgagggacaagatggtttctcttgggagttcctgagtggagcacccttccaggctttttgaaagccagctgatctgtggagccttgttaagggactcaatacggtgtttggatattgatgtttttccttgagactgtcttgtccatcaataaagatggaggatgtctcctctttgaaccccgcttccccaccagtactctctctcccttagagtttatgagttattcaaggaggagacttcttaaagacagcaacgcaattcttgtaacttgtgtaaatagccccatctttcagagtgataccatttctacatttgataatgcctgtattcctgtaggatgtatatagtttaggggattttttttttgtttggttttgttttttagaagtcaatatgtctggttttatttattgcttgaaaaagatcatttgaaaaaaataaatacattttcaaccacaaaaaaaaaaaaaaa

SEQ ID NO: 9 - DNA, 1843 bp, Homo sapiens
acaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatg

SEQ ID NO: 10 - DNA, 1436 bp, Homo sapiens
gatgctggatgagtccttggcagtcaggaggtccaaaaaatgcaaagaaatgataatgcactgggagaagaaagaagatattgacatcgtgaacacagtagaccaattggacaaaacagctcctcgtatcacactcttgcattccccttctcaagtggggctcctgaaaaatggctgctacgggatttacatcacttcccgcgtgttgaaggcatcagaccctgacactgaggacgatcagatcatctttaaaattctacaaggcccaaaacatggacatctggagaacacaacaacaggtgaatttatccatgagaaatttagccaaaaggacttaaacagtaagactattctttacatcataaacccatctttggaagtaaattcagataccgtggaatttcaaatcatggaccccacagggaactcggccactcctcaaattttggaactgaagtggtctcatattgaatggtcacagaccgaatatgaagtctgtgagaatgtgggtttgttgcccttggaaattatcagaaggggatattccatggactcggcctttgtgggtataaaggtcaaccaagtgtcagctgcagttggaaaagatttcaccgtgattccatctaaactgattcagtttgacccaggttcgtccatcctctgtttatagaaatggaacagacatcatctataattatcatgggatagtttccttgaaactggaggatgacagtttcccaactcacaaaaggaaggccaaagtatccatcattagtcagccacaaaagacaatcaaagtggcagaactgcctcaagcagataaggtggaatccacaactgactcacacttccccagacaggaccagttgccctcatttccaaagaactgcactctggaattaaagggactcttccattttgaagaaggcatccagaagctgtatcagtgcaatgggatcgcctggaaagcctggagtccccaaaccaagacaactgtttttcaggatgtggaagacaaatcctgtccagccgggtggcaccagcactcaggctactgtcacatcttgatcacagagcagaaaggcacctggaatgcggctgcccaagcttgcagggaacaatacctgggcaaccttgtaactgtattctccaggcagcacatgcggtggctctgggacattggtgggagaaagtccttttggataggtttgaacgaccaagtgcatgctggccactgggagtggatcggtggtgaacctgttgccttcaccaatgggagaagagggccctctccacgctccaagcttggaaagagctgtgttttggttcaaagacaagggaaatggcaaacaaaagactgtaggagagccaaacctcataattatgtgtgttccagaaaactctaaatataacagaccctacagggggccacctgg

SEQ ID NO: 11 - DNA, 3174 bp, Homo sapiens
gtgcgaggctaatagagtgatcagaaccaggaatgtgagctgggttccaccttaggaggggacaatgaggacagagcaagagggctccatgtttaattactccaggctctgacttctgcccacaattacagagcatgaaagcagaattggcctttagtaagtgaaaaggaagtggctcctgcagcatataattgttataatttcgtatttatggaaagagaaaaggacttcagtccactcatgttgttaagcacttgtccctcactccactggagcccccttcctatgttttgggcacagatggctgggaccgagaggaaagaggaagagcggctgccagagtgtgaatatacccctcagggatatacagcggagtttcatgataaactacccatactttcccaaaaaaggttgaggagcaatacataactttgcagattacaaacccttgttttactttttaaaccttttttccatactctgcttattggaaatcgatggctgtgatgtgaccaacacctgtgatgatagcaaagcccctcctttcacagtctcctgactgttcggggaacctccttggtcattggtagaaagctttagaaaagacttagctttttagggaagaactaaaaaatctccaaaacatactagtcccatgacttcgataactgaaaatgtcctgggtgtaaactaacccaggaatgtggatcatacatgttttttttaaaaaaaatccctgaatcaatattttcctacaacacaccctaaaattcctatttttgtaattaatggttggacagtgatcagccatttaaacataggctttctggaataaccagacactagaatagtttccaaagtgttttgcgtatcaaaatcctatatacttagaagaagaactcaggataagaaaaaatcgctaggtcccaaagggttcatgactatcatcagatgcaactgcgagtggcctacggtcattttttcaaatgagaagactggagagagagaacaacagtaatcacaaaacctctgttgcccttagtccatgacaatgtttaaggaaactttaaaaaattaagccatcttctgaattgttttctacaccaaatctaaaatattaaaatgaaattattaaatatttaaaatggggtatttagtggaaatgcaatcagtagaaaacattgctttttagtgcctgctaaacaagtaaaggagaaagaatgaagagaaaacagcagtccttcctgtgtgacactcgtgtggaaatgacaggcattcacatgtcattgagtgctaactcaaaagctaggtggcaatgctgtccaatgtttagagatcttttgaaatataattttaccaccattcagaggtaagtacttgcttaacagaagtctttaatgttagtgaatgaatgtataaaattataaactatgcattttcaaagagtagcatgtattttgtatcgaatccaagtaaatttttttcatagctacctaccacaactgcaaattattcaaaataaacttggatacatatccttatggggatatgggaagcccatctatattctcctacttgatgtttttaaagattgaaactttattctgaaacatcaggctctaaaaaattccatcattaagatgaataaatgggaaatggtttatttgttacttcgtaagcataaatgggaaatgttggctgttagaaaatgtgcccagttctttaaaggtggatgttctagtaacactggattaacaagcaaacaaaactgcatgaagtgaacgaatatttcattggataaagttagcataggttttatctgctgggtttaattctcaatcccagaaaaaaatattcttcaaggggtatcagttatagtttcaaagaacaaaatatgaaaatattgtccagcaaagcaaatcattgatcttttttcaaaattacttatattttggaaagtctatatagaatatccacaaatttcttcagccctcttgttgatttcatattttcatgaaactttttcccctaataatttgtcttcgctctttaatcagtgctttactacattactcagcctgaaaaaatatcttttccttcatctgacaatgtggaaataaagaactccatttctgtcattctggttctcttcagtgtccattgagaaagtttctcaactgtttgtaaaatacggggggaaaaaaacacgcatttctaaacctggtacttaaggttatactggattgtttgctacctaattagaagttattggggaaggggcattgtgtctttttatatgatttttagccaaatccagatgttctgatacacatttctgaatacctgtctgactgtaaatacagcctgtggaggttcaggttgataaacctttcacctgactgctccacagccatgctccttgccagcttctggcacattgtacatagatttgttgaatgtttaaatgatgttgtttttctaaatgctgttctctaaaacaattttttgaatttcttttgctttccattgttttggactttgtgtgttcgttttttaaaaaaaaaaatgtttcctaaatatttaacaccaggaaaaatatttttaaatacactggtgctaattgaaacagaaggaaattttcagatcgaagatgtacaatgttaaatgttcataccagttaaactgcactttcccaaggggacagctggcatctacttgaaatgggcatcaagagaccaccaaatgtttacagtttctgtggcccgtttaagtgtaaaatgcagaagtggctctgtccccccagagttaaggatttgctacactggtcctctggaagcatttaagtagaagaaaaggcttatagtcagaatcactttagtaatcgtcttctggtccttggacttttctgttctgtaatgcttgtaacaatgaatatggtgttgccaatctagtctgatatcattgttgacctgtacttactttgtggatggttctacctggggttgcactggcacaaacagagccagaacactggactttcaaaagaccattttgacttctacagtgtccacacacatgaatttaaatgcacttgtaactggttaattaccatgaagtaagtctaacttccacttaataaaagtttttgtgtatctgaaaaaaaaaaaaaaaaaa

SEQ ID NO: 12 - DNA, 3091 bp, Homo sapiens
gggagacccaagcttctagagatccctcgacctcgagatccattgtgctctaaagagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcatgtggtgattccccggatccaccccaactccatctgtgcagcaaacaacacaggggtgtacatcctcacatacaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaagcctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcctttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtacaacgcttcagcctactgcaaatccaaacacaggtttggtggaaaatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttgtaaattagggcccaattaataatcagcaagaatttgatcgttcagttccacttggaggccttcatcctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttggggtgtactagttacacatcttcaacagaccccctctagaaatttttcagatgcttctgggagacaccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaaaa

SEQ ID NO: 13 - DNA, 2530 bp, Homo sapiens
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaagaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttatttaaaaaaaaaaaaaaaaaaaaaaaaaaaaaaaaaaaaaaaaaaaaaaaaaaaaaaaaaaaaaaaaaaaaagaaaaaaa

SEQ ID NO: 14 - DNA, 9586 bp, Homo sapiens
gctggaagtagtccatttgtttagagtatcacaggtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacaaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcctttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagttgctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgacctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactataataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatgaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttatgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtagctggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcatttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctggatatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcaaaaaaaaaaaaaaaaa

SEQ ID NO: 15 - DNA, 4857 bp, Homo sapiens
cagactcacgcagctccagcccatcttgctgacctaattcagaaaagaagtgctacagctctgtgcctgtcatctttgcagtgtagcattttcaggtgatctaggaaacagttatttttatgagcaaataagagaaacaggaatcatgatggggatatatttaacagacccagtactggataaaacttaaagccagtttctattcaacatagtgaaaaggtcaccttgcctggctgagaaaagcagcaaaatatcagctttgttggtttcagttaacctcttagcccgggctaatctcttttccttgatgttcaaaccaatttgggatatctaactctaaagagagacacactgtactcatggtagatgacaaggaaaagaacatgaaatgtctcaccttcttcttgatgcttccagagacggtaaagaacaggtccaagaaaagctcaaagaaagcaaataccagcagcagcagtagcaacagcagcaagttgccaccagtttgttatgaaataattaccttgaagactaaaaagaagaagatggctgctgatatattcccccgtaaaaagccagccaactccagcagcaccagcgtccagcagtaccaccagcagaatctcagtaacaacaaccttatcccggccccaaactggcagggtctttatcccaccattagagagagaaatgcgatgatgttcaataatgatttgatggcagatgtacattttgtggttgggccaccaggtgggactcaacggttgccaggacacaaatatgttttagctgttgggagctctgtgttccatgcgatgttttacggagaacttgcagaggacaaagatgaaatccgtataccagatgtcgaacctgctgcttttctcgctatgctgaaatatatctattgtgatgaaattgacttggctgctgacacagtgctggccacactttatgctgccaaaaagtacattgtccctcaccttgccagagcctgtgttaatttcctggagaccagcctgagtgccaagaatgcctgtgtgctcctctcccagagctgcctgttcgaggagccagacctgacccagcgttgctgggaggtgattgatgcccaggctgagttagctctcaagtctgagggattctgcgatattgacttccagacactagaaagtattctccgtagggaaactctgaatgccaaagaaattgtggtttttgaggcagctctcaactgggctgaagtagaatgccaacgacaagatctggcgttgagcattgaaaataaacgcaaggttctaggaaaggcactttacttgatccgcatacccacaatggccctcgatgattttgcaaatggtgctgcacagtccggggtattaactctcaatgagaccaacgacatcttcctctggtatactgcagccaaaaagcctgagcttcagtttgtgagtaaagcccgtaagggccttgtcccccagcgctgtcaccgtttccagtcgtgtgcctatcgaagcaaccaatggcgctatcgtggtcgctgtgacagcatccagtttgcagttgataaaagagtgttcattgctggctttgggctgtatggctccagctgtggttctgcagaatacagtgccaagattgaacttaagcggcagggcgttgtcctggggcagaacttgagcaagtacttctcagatgggtccagcaatacctttcccgtatggtttgaatacccagtgcagatcgagccagacaccttctacacagccagtgtgatactggatggcaatgaactcagctactttggacaagaaggcatgacagaagttcagtgtggcaaagtgactgtccagtttcagtgctcctcagatagcaccaatggcactggggtacagggagggcagatccctgaacttatattctatgcttgaaaactcacttcctgaagcagcttgagctccaaagtgcacatctggttccaacttgcctgatgcttagctcatctgcaaatatgtgatcagtgccggtaatttgtaatgaatgaagcggtaggcaggttctaatttcttttaaccttttaattatgtacaggcaaaaatgcagcattccgcttttaactatctgcttaaaagagctaacgttcttattaaggctttgtggtttttagagttgcatctatgaacctggggagattatgtgctttcccaagcgttccaccaccctctcagttttgtccctctgaagataattttggatcaccttgaatttccttttggacgttatttgatgaacagaaataaattgataacaagagttatttttaaacagaactcctcttaccccccaaaacagataaacctcagtgtacaattttgaaagaagttttgccttgtaatgagtaataatttagaaagtagacagtggttgtgtttggctctcgttttattccttttacatttgttgcttctgggatttaaaaaattactaaattcataagatagttaggtattaaacacttcagaatatcaatgtaaaattggaaaataaggaactgggggcatttgtttaggccatgacttctacaagcagatttcttttcttttagtttagaagacaaaaaatttcaatacagatacttcttttagaagtaaatttttagattttattgtcagtagaaaaaagttaaactcctactaatttaaactaagacagtttaaaaaggaagcctgaaaaagactcatactacaaataatttaattgatggcatataagaatatgcagtttgaaaaagccaaactcttctctccacttagcttttgatccccactgtttgcttatttgtataagtcatactgtgtagaatttctattttctttttccccattaaaagaggaccaaacaattctttatacaaatggagtagcaactagttttgtagcactacatttaatgtaatgagatacctttgttcatttttttaaatttgaaatatactttacctgatccactttgattgtatactatattctttgttaattttaattttgtcctgttcctagactgctagaatctggcccctggccatcttaaagtgccaacatatgcctgcagggtttataaaaaatggcctggagtgacacattttattatacctaatattcactgcatcagtatcacatctagctcccttacttgtccacagataatgtaaacaaaggagggaaaaacttattaaattctccttcgctgctggcttgtgctggtttagtgcctgtgtccctggcagtgtccagtgtgttcacttccagttgaagtatccatgtgtttctgggcagcttttctgctcagtgtgatcctgagatggcttccccgccgccacccagagtgtggtccttggccgcctcctgctcctgctctgcaagcctgaaactggcttgtctggagccaggagttagtcctggggtgtgtgtgtgcctgcgcacccatgcgcatgcaagtgtgtttgccagctcaggagctgtctcctctctacctggctagtaagaggtgggacagtaatggtcctcctgctggccccagcaaggcccatgagtgactgccctgacgtattcactgtgcctctgggccacttcttcccctgtagatgtgggcttgttgccttcagccggcttccctgagggaggagaacactggattattggaaatgttttaatcactcttgccattacctacatctattagcatagatgatgaaaagctgttactggtgattatagatgagtatttccaggacaacattctaaaagtacaattatttcttattggggagattacaggtagtttggcaaagcattgaagtacaaaggtacattttcaattaaaaagcacacttctacaaaagatttggtttttaaattatggttacacatttcagtaactcatagctgctgtgcaaattggtagaccttataagaaggcacttgtttgtaagccagagaagaaactttaattgcatcctatcagattgttgaggtgggtgtgatagtcttcaggtgcagtgcgttcattcactaacgctcactgtcagtgcccatgtttgctagctgcctccatgtgactagtgagctgctggtgaaagtcgtgtgaaatcctgtacactgtgtatagaacaatgtaattttatgttaattgttattactttaaaacatatctaccatctgattggctggtaccgagagctgtgggtaaaatttgaaaattgtatttagaataagaaattttacattttaaaccctattgtcctttatgcattttcaatgaaatggaatgaaggctaatatgcttgctttatttacttttgtaatcttggattttgtagcttttaaaactagaaaccattgttctaacaaagcaggcaactttattctataaacacaactttattaagcagaatacactgtagatgcttttccccaacgtatctggctggcagtctttgtcgttgttcattctggggataaaggggaactaggctagcagttctaatgtgacattctttaagcatatcttaaaatagtatttaagtaaatggtctaatttctacataattattgcactgaacttttttgtttattaaggtgtttaaataagctcagctaattcaagacactgtagtcacttgtgcatcagtgtgcttgaatttagtagcttacagcattatttatgaaggaaaaaatacataaatatgaagtacctcatgttgaatgttattgtactgtatttttaatgtaacagtgcagatcttgttagacacatgaatgtgtataatcatgttaaatgcaaataaaactagttcataga

SEQ ID NO: 16 - DNA, 2458 bp, Homo sapiens
ctccggtgtgtctgtcggttgcagtgttggaggtcggcgccggcccccgccttccgcgccccccacgggaaggaagcacccccggtattaaaacgaacggggcggaaagaagccctcagtcgccggccgggaggcgagccgatgccgagctgctccacgtccaccatgccgggcatgatctgcaagaacccagacctcgagtttgactcgctacagccctgcttctacccggacgaagatgacttctacttcggcggccccgactcgacccccccgggggaggacatctggaagaagtttgagctgctgcccacgcccccgctgtcgcccagccgtggcttcgcggagcacagctccgagcccccgagctgggtcacggagatgctgcttgagaacgagctgtggggcagcccggccgaggaggacgcgttcggcctggggggactgggtggcctcacccccaacccggtcatcctccaggactgcatgtggagcggcttctccgcccgcgagaagctggagcgcgccgtgagcgagaagctgcagcacggccgcgggccgccaaccgccggttccaccgcccagtccccgggagccggcgccgccagccctgcgggtcgcgggcacggcggggctgcgggagccggccgcgccggggccgccctgcccgccgagctcgcccacccggccgccgagtgcgtggatcccgccgtggtcttcccctttcccgtgaacaagcgcgagccagcgcccgtgcccgcagccccggccagtgccccggcggcgggccctgcggtcgcctcgggggcgggtattgccgccccagccggggccccgggggtcgcccctccgcgcccaggcggccgccagaccagcggcggcgaccacaaggccctcagtacctccggagaggacaccctgagcgattcagatgatgaagatgatgaagaggaagatgaagaggaagaaatcgacgtggtcactgtggagaagcggcgttcctcctccaacaccaaggctgtcaccacattcaccatcactgtgcgtcccaagaacgcagccctgggtcccgggagggctcagtccagcgagctgatcctcaaacgatgccttcccatccaccagcagcacaactatgccgccccctctccctacgtggagagtgaggatgcacccccacagaagaagataaagagcgaggcgtccccacgtccgctcaagagtgtcatccccccaaaggctaagagcttgagcccccgaaactctgactcggaggacagtgagcgtcgcagaaaccacaacatcctggagcgccagcgccgcaacgaccttcggtccagctttctcacgctcagggaccacgtgccggagttggtaaagaatgagaaggccgccaaggtggtcattttgaaaaaggccactgagtatgtccactccctccaggccgaggagcaccagcttttgctggaaaaggaaaaattgcaggcaagacagcagcagttgctaaagaaaattgaacacgctcggacttgctagacgcttctcaaaactggacagtcactgccactttgcacattttgattttttttttaaacaaacattgtgttgacattaagaatgttggtttactttcaaatcggtcccctgtcgagttcggctctgggtgggcagtaggaccaccagtgtggggttctgctgggaccttggagagcctgcatcccaggatgctgggtggccctgcagcctcctccacctcacctccatgacagcgctaaacgttggtgacggttgggagcctctggggctgttgaagtcaccttgtgtgttccaagtttccaaacaacagaaagtcattccttctttttaaaatggtgcttaagttccagcagatgccacataaggggtttgccatttgatacccctggggaacatttctgtaaataccattgacacatccgccttttgtatacatcctgggtaatgagaggtggcttttgcggccagtattagactggaagttcatacctaagtactgtaataatacctcaatgtttgaggagcatgttttgtatacaaatatattgttaatctctgttatgtactgtactaattcttacactgcctgtatactttagtatgacgctgatacataactaaatttgatacttatattttcgtatgaaaatgagttgtgaaagttttgagtagatattactttatcactttttgaactaagaaacttttgtaaagaaatttactatatatatatgcctttttcctagcctgtttcttcctgttaatgtatttgttcatgtttggtgcatagaactgggtaaatgcaaagttctgtgtttaatttcttcaaaatgtatatatttagtgctgcatcttatagcactttgaaatacctcatgtttatgaaaataaatagcttaaaattaaaaaaaaaaaaaaaaaa

SEQ ID NO: 17 - DNA, 1887 bp, Homo sapiens
ggggtatcgataagtttctttttttttttttttttgagacagaatctcgctctgtcgcccaggctggaatgcagtggcgcgatctctgctcactacaagctccgcctcccgggttcacgccattctcccgcctcggcctcccaaagtgctgggattacaggcgtgagccaccgcgcccggccttaaaaattgaatctgtagcttaggccatccaaattttataaatccaaattaactttagaatgtttctattactttcacttttacatatataaattttaagtgtcctgattggctgaacaatatctcacatcaaatgctttgcctggaaatagatatcccactggggatagtggtgtgtaaactatgacttggacaattctatatactcaagcaccataaaaagtatgcagttgaaaagaaaatcaaagttgactcctgggtgccaactaaatattcaaatcaggtactcatccttatcagctaaattcattttcaccaggaacagaccaccaaataaattattttatcctaataactagttttgaagcagtgtaattactctggaagaaggctctaaaaagtcatgattcccccactattttgaaatgtatcctctaacaaggatcattatagtgtaatcttaatttttatgtttatcaagatgaaatcttgtttgaattgtgatattataaaaggggactcaaaaatccaagcagtctactgtgtttaaattaacaccacaaccttccttatcagattataagagtagaaaaattaacacttggtgtgtgaatcttcaggaaaatgagctatttcataagctcaaacaagcagcttccttttccagagaatatagaattatattatggtctccttaaatgtttagtagctcttatggtcacagcatttttaatctccctatggcatctttatggaataattttctaaagggtaattctctactaaaaatatcagaccccgaccatatttaatgtggagagcaataccctcttagaaagaaaatacattgactcatacacttgttaaaagttaataaagaaatagctcatttttaaagccggaagtttatggtctctgcatcgtcaatttaatttaagcattgctgagacaatctttaatctactcccctttttgtaataccttatttatggtgcattttcatttttatttgggggaaacgttagcccaacagagccggcagatgaaagtgttgaaaagaggtcaaatggaaacaaaggctcttacccgctgtatttcagacaggactgaggcacttagccgaggagccactgggttattagattaatttcaaaagagcttttacaagttgcttaattcctttttttttttttttttcaaaaacccatgaaccacaaactcaaatttctcctcaaatggggttaatctgacaaatgaggcatggacccagccttgtggaaaaagcattccacgctaatgagatcttggtctttcttgtgaggctacgttatttatgtaaatatgtctggaggcaccttctctaagcttttagttttctatgatctattagtttagtgtttattaaagaatcaaatgtatagaattaccaggcattcgtggggaatgctgtgtagcaaatgtaaaactgacctgctcggaagaaacgtaggaacgcttcaaacccactgtaatgtttggtttgagattattttcattgctttgagagtgaactgcctaagagtaggccttataataaatgctatgtgcgtcttcagtagttccaagctaaagcaatttggcattctcccactgtgatttgtgacttttaaacccacaaaataaaagctttttggtattgataaaaagaaaaaaaaaaaaaaaaaa

SEQ ID NO: 18 - DNA, 2100 bp, Homo sapiens
tccgtgcccctgcggggagcgcgccggggctgccccccgaatgacgggcggaaggttcgacttcgacgatggcggcacctactgcggcggctgggaggagggcaaggcgcacgggcatggcatctgcacggggcccaagggccagggcgagtactcgggctcctggtcgcacggcttcgaggtggtcggaggctacacctggcccagcggcaacacctaccagggctactgggcgcagggcaagcggcacgggctgggggtggagacgaagggcaagtggatgtaccggggggagtggtcacatggtttcaaggggcgctacggggtccggcagagcctgtgcacccccgctcgctacgagggtacctggagtaacgggctgcaagacgggtacggcgtggagacctacggggacggaggtacctaccagggccagtgggccggaggcatgcggcatggctacggcgtgcgccagagcgtgccctacggcatggccacggtgatccgctcaccgctgcgtacctcgctggcctcgctgcgcagcgagcagagcaatggcagcgtgctccacgacgccgcagccgccgccgacagcccggccggcacccgcggcggtttcgtgctcaacttccacgcagacgctgagctagcgggcaagaagaagggcggcctcttccggaggggctcccttcttggaagcatgaaacttcgcaagtccgaatccaagtcttccatctcgagcaagcgcagctctgtccgcagcgacgcggccatgagcagaattagttccagcgatgccaactccacgatcagctttggcgatgtagattgtgatttttgcccggtggaagaccacgtggacgccaccaccacggaaacctacatgggcgagtggaagaacgacaagcgcaacggcttcggcgttagcgagcgctccaatggcatgaagtatgaaggggagtgggcaaataacaagaggcatggatatggctgtaccgtgtttcctgacggctccaaagaagagggaaaatacaaaaataatattctggtccgtgggataaggaagcagcttataccaataagacatacaaaaactagggagaaggtggacagagcaattgaaggcgcccaaagggcagctgccatggccagaaccaaagtggaaatagcaaattcaaggactgcacatgccagagcgaaggccgatgccgccgaccaggccgcgctggccgctcgccaggagtgcgacatcgcgagagctgtggccagggagctgtcacctgatttctaccaaccaggccctgattacgtcaaacagagatttcaggaaggtgtagatgctaaagaaaatccagaagaaaaggtaccagaaaagccacctacaccaaaggagtctcctcatttttatcgcaaaggcacgacacccccaagatctcctgaggcaagtcccaaacacagccactctcctgcttcctccccaaagcccctgaagaagcaaaaccccagctcaggggcgagactcaaccaagacaaaaggagtgtggctgatgagcaggtgacggccattgtcaataagcccttgatgtcaaaggctcccacgaaggaggcaggagcggttgtgccccagtccaagtactctggccgccaccacatccccaaccccagtaacggggagctgcattctcagtatcacggctactacgtgaagctgaacgccccccagcaccctccagtagacgtggaggacggcgatggatccagccagtcttcctcagcactggtgcacaagccatccgctaacaagtggagtccctccaaatctgtgacaaaaccagttgccaaagaaagcaaagctgagccaaaagctaagaagtctgaacttgctataccaaagaatccagcaagcaacgattcatgccctgctttggaaaaagaagccaattcaggccctaattcaatcatgattgtccttgtcatgctgttgaatatcgggttggccattctttttgttcactttctaacttgattggaattaggaaagttgaatatcgggttggccattctttttgttcactttctaacttgattggaattaggaaa

SEQ ID NO: 19 - DNA, 241 bp, Homo sapiens
gcttcaaagacattttattctaacagcagaaagaaaacagtcattgctgaaaaaacaacttttaatactttctataccagaataaagttctgtcaactgatgtattataataataaataatgaccaagaataaactttaaatacaaagttttctacttgttacaagcatagcaacaaaatcctctactcctattgatctcagatttcctccaagatagatttttttttctttgcgtaggaa

SEQ ID NO: 20 - DNA, 1055 bp, Homo sapiens
  misc_feature (767)..(767): n is a, c, g, or t
  misc_feature (823)..(823): n is a, c, g, or t
  misc_feature (837)..(837): n is a, c, g, or t
  misc_feature (914)..(914): n is a, c, g, or t
  misc_feature (963)..(964): n is a, c, g, or t
  misc_feature (975)..(975): n is a, c, g, or t
  misc_feature (1035)..(1035): n is a, c, g, or t
  misc_feature (1055)..(1055): n is a, c, g, or t
gctatgacatgattacgaatttaatacgactcactatagggaatttggccctcgaggccaagaattcggcacgaggcgataccatctaaacgatttagtgttgcgttgaagatggaggggctgtgttttcgttgttgaaaacacctctataatctgacaccagctgctgtaattcgcctagaaccctaatgagatgtgtcgggaggcagctgcggtgccagtcagactggagcggtcactgcagagaaaatcaattcacgtggtgttgtaactgcactcttggagaaaccttagacggcccgcagccagcgccggggctgaccggcactgcagaggattgagatcttaaatgcgcatttttacaaaatacacagccaaatgaaatcaatgatcaggaagtgtctgcagacaaatgtccattgcaggtttgatgagtaattcctttttttagatcaaattgttctcggtagccttttcttcttttttaaaaaaaaattttggatgaagaaggaagttgctattaaaaaaaagtagggtacattatataaaatgttgttagaaaaactagctaaccccatccatagaagatgctggtgagcaattaaaatttaggtaataatagaaagatttttttactatgatttttaaaattttacttgaatgaaggctgctccggtccttattatcggatttttttttcatgtgttggtttttataagtgtcacagacatgaagcaagattttcttctccagcaagctcttatganatagcttgtattaaaatatgaatctaaacatcgtgctctctatctctaatgacganactgtttgagttanaatgtctgttttttgtaaacaatgtgttcatatttttgtagatttagatttctactgattggtactccaattatcangtctgcacacacagaggagatttgagtgtcatatgaacactactcatannaatgattaganacagttaagttatctgatcgcagatgggtaagtgactttaaactccttgatgcataatgngtgtgctgggtgtaaaattn

SEQ ID NO: 21 - DNA, 7005 bp, Homo sapiens
gcttcagtcccgcgaccgaagcagggcgcgcagcagcgctgagtgccccggaacgtgcgtcgcgcccccagtgtccgtcgcgtccgccgcgccccgggcggggatggggcggccagactgagcgccgcacccgccatccagacccgccggccctagccgcagtccctccagccgtggccccagcgcgcacgggcgatggcgaaggcgacgtccggtgccgcggggctgcgtctgctgttgctgctgctgctgccgctgctaggcaaagtggcattgggcctctacttctcgagggatgcttactgggagaagctgtatgtggaccaggcagccggcacgcccttgctgtacgtccatgccctgcgggacgcccctgaggaggtgcccagcttccgcctgggccagcatctctacggcacgtaccgcacacggctgcatgagaacaactggatctgcatccaggaggacaccggcctcctctaccttaaccggagcctggaccatagctcctgggagaagctcagtgtccgcaaccgcggctttcccctgctcaccgtctacctcaaggtcttcctgtcacccacatcccttcgtgagggcgagtgccagtggccaggctgtgcccgcgtatacttctccttcttcaacacctcctttccagcctgcagctccctcaagccccgggagctctgcttcccagagacaaggccctccttccgcattcgggagaaccgacccccaggcaccttccaccagttccgcctgctgcctgtgcagttcttgtgccccaacatcagcgtggcctacaggctcctggagggtgagggtctgcccttccgctgcgccccggacagcctggaggtgagcacgcgctgggccctggaccgcgagcagcgggagaagtacgagctggtggccgtgtgcaccgtgcacgccggcgcgcgcgaggaggtggtgatggtgcccttcccggtgaccgtgtacgacgaggacgactcggcgcccaccttccccgcgggcgtcgacaccgccagcgccgtggtggagttcaagcggaaggaggacaccgtggtggccacgctgcgtgtcttcgatgcagacgtggtacctgcatcaggggagctggtgaggcggtacacaagcacgctgctccccggggacacctgggcccagcagaccttccgggtggaacactggcccaacgagacctcggtccaggccaacggcagcttcgtgcgggcgaccgtacatgactataggctggttctcaaccggaacctctccatctcggagaaccgcaccatgcagctggcggtgctggtcaatgactcagacttccagggcccaggagcgggcgtcctcttgctccacttcaacgtgtcggtgctgccggtcagcctgcacctgcccagtacctactccctctccgtgagcaggagggctcgccgatttgcccagatcgggaaagtctgtgtggaaaactgccaggcattcagtggcatcaacgtccagtacaagctgcattcctctggtgccaactgcagcacgctaggggtggtcacctcagccgaggacacctcggggatcctgtttgtgaatgacaccaaggccctgcggcggcccaagtgtgccgaacttcactacatggtggtggccaccgaccagcagacctctaggcaggcccaggcccagctgcttgtaacagtggaggggtcatatgtggccgaggaggcgggctgccccctgtcctgtgcagtcagcaagagacggctggagtgtgaggagtgtggcggcctgggctccccaacaggcaggtgtgagtggaggcaaggagatggcaaagggatcaccaggaacttctccacctgctctcccagcaccaagacctgccccgacggccactgcgatgttgtggagacccaagacatcaacatttgccctcaggactgcctccggggcagcattgttgggggacacgagcctggggagccccgggggattaaagctggctatggcacctgcaactgcttccctgaggaggagaagtgcttctgcgagcccgaagacatccaggatccactgtgcgacgagctgtgccgcacggtgatcgcagccgctgtcctcttctccttcatcgtctcggtgctgctgtctgccttctgcatccactgctaccacaagtttgcccacaagccacccatctcctcagctgagatgaccttccggaggcccgcccaggccttcccggtcagctactcctcttccggtgcccgccggccctcgctggactccatggagaaccaggtctccgtggatgccttcaagatcctggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagctgcgagacctgctgtcagagttcaacgtcctgaagcaggtcaaccacccacatgtcatcaaattgtatggggcctgcagccaggatggcccgctcctcctcatcgtggagtacgccaaatacggctccctgcggggcttcctccgcgagagccgcaaagtggggcctggctacctgggcagtggaggcagccgcaactccagctccctggaccacccggatgagcgggccctcaccatgggcgacctcatctcatttgcctggcagatctcacaggggatgcagtatctggccgagatgaagctcgttcatcgggacttggcagccagaaacatcctggtagctgaggggcggaagatgaagatttcggatttcggcttgtcccgagatgtttatgaagaggattcctacgtgaagaggagccagggtcggattccagttaaatggatggcaattgaatccctttttgatcatatctacaccacgcaaagtgatgtatggtcttttggtgtcctgctgtgggagatcgtgaccctagggggaaacccctatcctgggattcctcctgagcggctcttcaaccttctgaagaccggccaccggatggagaggccagacaactgcagcgaggagatgtaccgcctgatgctgcaatgctggaagcaggagccggacaaaaggccggtgtttgcggacatcagcaaagacctggagaagatgatggttaagaggagagactacttggaccttgcggcgtccactccatctgactccctgatttatgacgacggcctctcagaggaggagacaccgctggtggactgtaataatgcccccctccctcgagccctcccttccacatggattgaaaacaaactctatggtagaatttcccatgcatttactagattctagcaccgctgtcccctttgcactatccttcctctctgtgatgctttttaaaaatgtttctggtctgaacaaaaccaaagtctgctctgaacctttttatttgtaaatgtctgactttgcatccagtttacatttaggcattattgcaactatgtttttctaaaaggatgtgaaaataagtgtaattaccacattgcccagcaacttaggatggtagaggaaaaaacagatcagggcggaactctcaggggagaccaagaacaggttgaataaggcgcttctggggtgggaatcaagtcatagtacttctactttaactaagtggataaatatacaaatctggggaggtattcagttgagaaaggagccaccagcaccactcagcctgcactgggagcacagccaggttcccccagacccctcctgggcaggcaggtgcctctcagaggccacccggcactggcgagcagccactggccaagcctcagccccagtcccagccacatgtcctccatcaggggtagcgaggttgcaggagctggctggccctgggaggacgcacccccactgctgttttcacatcctttcccttacccaccttcaggacggttgtcacttatgaagtcagtgctaaagctggagcagttgctttttgaaagaacatggtctgtggtgctgtggtcttacaatggacagtaaatatggttcttgccaaaactccttcttttgtctttgattaaatactagaaattttttctgtttcctaacttcatcattgattgtttgaaatcttggagtttcaagcatttttttcaagctgagacggttccttttgcatgcctcctgactcactgactcctcactggctttgtgtctagtgccacactccatttgtgctgacgatgctatgaggctggcccgtgtgcaccctcgatttggaaggtcctcttctccgttgtaggctcagacaacagacgagtgcctcctttacgttagagaatgttttatagaacgtttccgctgcagtaagccattgagtgcagcagtgtgctgttgccctacactgccttagaaaaagagttaagcagttcgacaaatatacatcagattagagagtctcaagttcataaaagtcaaaattggtagtgtctgttaagttacatttaccaagagagcacatgatatttcccctaactataacagtgtttttggaaacctggaacacaaaaccattaatataattggcacagaaaccacgagtttggtttgaacatcaaagggagttttgccaaggccttactgtctgcacttgaagttttggttcttcagtgcagaacaaatgatctgttttcatttttaggcatgtcagacccgaactggcctggagagagtcctgtaccactcacgagagctgatggcactaacactgggtttccaagatatccaaatgatagtgtatatgctaactggatgctttcaccctcagcggcaaaattaatggacacgtttgatagttaacatttctttgtgaaaggtaatggactcacaaggggaagaaacatgctgagaatggaaagtctaccggccctttctttgtgaacgtcacattggccgagccgtgttcagttcccaggtggcagactcgtttttggtagtttgttttaacttccaaggtggttttacttctgatagccggtgattttccctcctagcagacatgccacaccgggtaagagctctgagtcttagtggttaagcattcctttctcttcagtgcccagcagcacccagtgttggtctgtgtccatcagtgaccaccaacattctgtgttcacatgtgtgggtccaacacttactacctggtgtatgaaattggacctgaactgttggatttttctagttgccgccaaacaaggcaaaaaaatttaaacatgaagcacacacacaaaaaaggcagtaggaaaaatgctggccctgatgacctgtccttattcagaatgagagactgcggggggggcctgggggtagtgtcaatgcccctccagggctggaggggaagaggggccccgaggatgggcctgggctcagcattcgagatcttgagaatgattttttttaaatcatgcaacctttccttaggaagacatttggttttcatcatgattaagatgattcctagatttagcacaatggagagattccatgccatctttactatgtggatggtggtatcagggaagagggctcacaagacacatttgtcccccgggcccaccacatcatcctcacgtgttcggtactgagcagccactacccctgatgagaacagtatgaagaaagggggctgttggagtcccagaattgctgacagcagaggctttgctgctgtgaatcccacctgccaccagcctgcagcacaccccacagccaagtagaggcgaaagcagtggctcatcctacctgttaggagcaggtagggcttgtactcactttaatttgaatcttatcaacttactcataaagggacaggctagctagctgtgttagaagtagcaatgacaatgaccaaggactgctacacctctgattacaattctgatgtgaaaaagatggtgtttggctcttatagagcctgtgtgaaaggcccatggatcagctcttcctgtgtttgtaatttaatgctgctacaagatgtttctgtttcttagattctgaccatgactcataagcttcttgtcattcttcattgcttgtttgtggtcacagatgcacaacactcctccagtcttgtgggggcagcttttgggaagtctcagcagctcttctggctgtgttgtcagcactgtaacttcgcagaaaagagtcggattaccaaaacactgcctgctcttcagacttaaagcactgataggacttaaaatagtctcattcaaatactgtattttatataggcatttcacaaaaacagcaaaattgtggcattttgtgaggccaaggcttggatgcgtgtgtaatagagccttgtggtgtgtgcgcacacacccagagggagagtttgaaaaatgcttattggacacgtaacctggctctaatttgggctgtttttcagatacactgtgataagttcttttacaaatatctatagacatggtaaacttttggttttcagatatgcttaatgatagtcttactaaatgcagaaataagaataaactttctcaaattattaaaaatgcctacacagtaagtgtgaattgctgcaacaggtttgttctcaggagggtaagaactccaggtctaaacagctgacccagtgatggggaatttatccttgaccaatttatccttgaccaataacctaattgtctattcctgagttataaaagtccccatccttattagctctactggaattttcatacacgtaaatgcagaagttactaagtattaagtattactgagtattaagtagtaatctgtcagttattaaaatttgtaaaatctatttatgaaaggtcattaaaccagatcatgttcctttttttgtaatcaaggtgactaagaaaatcagttgtgtaaataaaatcatgtatc

SEQ ID NO: 22 - DNA, 735 bp, Homo sapiens
gagtctgcccttgcgagctcagagtgtgcccgtgcgccgccgccgtcgtacctgccgccgccgccaccgccaccatgcccaacttcgccggcacctggaagatgcgcagcagcgagaatttcgacgagctgctgaaggcactgggtgtgaacgccatgctgaggaaagtggccgtagcggctgcgtccaagccgcacgtggagatccgccaggacggggatcagttctacatcaagacatccaccaccgtgcgcaccactgagatcaacttcaaggtcggagaaggctttgaggaggagaccgtggacggacgcaagtgcaggagtttagccacttgggagaatgagaacaagatccactgcacccaaactcttcttgaaggggacggccccaaaacctactggacccgtgagctggccaacgatgaacttatcctgacgtttggcgccgatgacgtggtctgcaccagaatttatgtccgggaatgaaggcagctggcttgctcctactttcaggaagggatgcaggtccccgaggaatatgtcatagttctgagctgccagtggaccgcccttttcccctaccaatattaggtgatcccgttttccccatgacaatgttgtagtgtcccccacccccacccccctggccttggtgcctcttgtatccctagtgctgcatagcccggcatttgcacggtttcgaagtcattaaactggttagacgtgtctcaaa

SEQ ID NO: 23 - DNA, 2872 bp, Homo sapiens
cggcgctgggagacaccggacgcccgctcggctgcgctgcggctcaggcccccgctcgggcccgacccgctcggtcaccgccggctcgggcgcgcacctgccggctgcggccccagggccatgcggaggcccacgaggaggccggcggccacgcgcatcccgtagcccaggtggcccaggtctgcaccgcggcggcctcggcgccatggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaaggtcctggcagcatacagggtgttcatggagcgagtgctcagcctcctgggtgcagacgctgtggaacagaaggcccaagagatcctgcaagtggagcagcagctggccaacatcactgtgtcagagtatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtccacgtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggttttacactgtccaaaggtctcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgcactgttaaaaaaaaaaaaa

SEQ ID NO: 24 - DNA, 2265 bp, Homo sapiens
ggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgaggccaggtctccagctggggtggacgtgcccaccagctgccgaaggccaagacgccaggtccggtggacgtgacaagcaggacatgacatggtccggtgtgacggcgaggacagaggaggcgcgtccggccttcctgaacaccttaggctggtggggctgcggcaagaagcgggtctgtttctttacttcctccacggagtcggcacactatggctgccctctgggctcccagaacccacaacatgaaagaaatggtgctacccagctcaagcctgggcctttgaatccggacacaaaaccctctagcttggaaatgaatatgctgcactttacaaccactgcactacctgactcaggaatcggctctggaaggtgaagctagaggaaccagacctcatcagcccaacatcaaagacaccatcggaacagcagcgcccgcagcacccaccccgcaccggcgactccatcttcatggccaccccctgcggcggacggttgaccaccagccaccacatcatcccagagctgagctcctccagcgggatgacgccgtccccaccacctccctcttcttctttttcatccttctgtctctttgtttctgagctttcctgtctttccttttttctgagagattcaaagcctccacgactctgtttcccccgtcccttctgaatttaatttgcactaagtcatttgcactggttggagttgtggagacggccttgagtctcagtacgagtgtgcgtgagtgtgagccaccttggcaagtgcctgtgcagggcccggccgccctccatctgggccgggtgactgggcgccggctgtgtgcccgaggcctcaccctgccctcgcctagtctggaagctccgaccgacatcacggagcagccttcaagcattccattacgccccatctcgctctgtgcccctccccaccagggcttcagcaggagccctggactcatcatcaataaacactgttacagcaaaaaaaaaaaaaaaa

SEQ ID NO: 25 - DNA, 3440 bp, Homo sapiens
tgcttagagtcaggagaataaacggtcccatatagagataggtttatgaagcggagtctgaaggatgagcttcatcagcaatcctcagaatgtcagttctactagctaaggatgcaggtaagtatgttggacaccaagagaacaggaaggaagtgttttgaacactggaggtgggtcatgaggaagcttatacatattcacattgtgaatcaatttcaaggacagatgaacaaagactgggcgttaccaatagagcagggttttgttttgtttttcccctaaggcaaaaggcagaaatgagtgggtacaccatgattaagttgcattctgtagagataggatcatttaagtcaagtcagcaacaaaaattagagacattgaagatgatggggtagaaaaggggtatcaaataggttagaaagatggcttgaaaggaaatgagggaaatttcagtgagtttgaggaatggcagactgggtatgtgacaaatgagtgggtaaataaggaaatctcagattgagaatcctggcagatctttcaatgggttagactgcaggaatattgattttaaagccagactgaagcaaattctagtgataaaggaaggggaaagggtggctgaatcaaatgttctaccaatactgctttttttagtatttgagttaaaattcagattaaatgcttggcttagaagaatgcaaagcttcactgagcctaataatatggatcccagtgggtgagtggaggtgagttaaagtaaaaaactctgaggcaaatcttacttaactgaagttgtgtttttagtacagaatgccaagttaatatggttaatactgaacaaaaaataatggaagggcaactacagtagcttaagatggcactttaaggaagtgtaggcagaaagtcaagaaattaaaataattatgaatcattatatggcaggcaatatttccagtgaaaatcagagaaaataaactcacatacatgtactgttacagctgatcttagtatgaatattttctattaaagactgttttaaaataagttattaatatttgttgaaatggttccagataacaagaaatatgatgcaataaaacctgataaataaaagcaatataaagattagaatggttttgaataggtagtggaatagaaagttaagttggtagttgcattaaaaaggtcaaacatggggaataattggtagaatgttgtgtatataatatatattgttacgggtgcaataaatattcaggggaaacagagctgctgaaagagaatgaatgcttagaaggaatgttgccttaaaggcttttctaaaactttttaggtaaaggacaaattctgggaggacgaaagataataagtaggactagttacatagagacttaggatgtccatagtctttcaagaaattgcccaacctttgcgagaaggtgttatggtaatatattgatgttgggttaaagcaaattttttcagatagggtagatttttatacatttataaagtaaaggggagtaggaaagattaaagatagatcaaagaaaggaataattgatggaacaactttctggaagagattagagggtatgtgtcttttgaactctggaagacttgattttagagaggataaaggaagaaagtggataattctagaattaaacaccaaaaggttctatgtgtctggcaccatgtgaagcaacttacctattatttcatttcatttcatttcatttcatttcatcctataacagtcctaagagatcaaataatttgtccacgattacacagtcagtatgtagcagggccagcattcaaatcctcatctgtctatcaaacccatattcccttctattatgctatactgttttcaagttgaaggaaatcaaaccaagaatttctgttttttcactgcgattataaggaaaaatattatttttctgaaatgagacatattgatgtttaagaccttgaggtgacaggtaaaatttggaatatctgtgatgggaaaatgcaaaaaggaaggaatgggtgaaagatacctattaccatctatgccctggtatttcacttcttccattgcacagcatagactttagattggccatggattaaaaatttgagaattctgacaaaaaactaaatagaaaggagtttgttttttaagtaggtatatgatgggtcaaatataaacttactactaacaaaactttaaacaattccctaaatgccaaacttttataaacaaaaatcaaacaaaccatcaagcaaaagagtccatagccagcagaccaaatgttgaaatctctgggctaatttgtaagatctatgttttaaaactccttagtgaagaggggcaagaaaacctctcctctttttcctctcttggtggaaatgttttgttgttgttgttggttttttcctatactatatgtaatttctatattgttgttttgtgtattttggtattataaaattatacttcttagattccgttaagaatactttctggggtgtgagccacctgagttattagttagcaaaatgaacctggggaagtgggaagagctggtattctcaattggcaagggattgattcttcaatgggttcagcatttcacttccctctgaaattaagtggcaaagtaatagcatcccttaaaaaacaggacattggtgagaggtagaatagcaggaggaattttgaaacatggagggatggctactggaaaagaacagatgaagtgcagagtctctccagacaatggtagaaaccacaggactacattaagattgggcccaaatactagtttagaaaaaggtaaataaaactagctttacttaagagtacagccagcttaattactggctagtggacatatttcagacaaatctaactggagagaaaaacagaccaggagagaaagcgaagttacaaggaaatggaactagagaaacctcacaaagggataaaggaggtaattaaaggttaaagccagatagcctcgagctcaaaggagaaatattggaggccagataggaaagtgccttcctactcagggggttatggatccagggtggctaaagaatagaagtagagttccacccagggccagagggaacaatctgggattcagacacagcagtggtgccaacgtgaatctacctcgtgctagagtctgagtagcctagtctatcacccaacacagataagactggacaggggctcccaggaaccaacatctaagaagggagtttggagaggggctaaaagaaagcaggttaagccccaaatgtaactgaatgatgaccagggataactatttactagtgcttttatgatttattgtaactctgtaactttcccagtatttgttaattttttaacttctgtttctcctgtacttacgagcagtaaaagttgttcaaaacat

SEQ ID NO: 26 - DNA, 7318 bp, Homo sapiens
gagcccattagccgcacaaattcgcagcaggcggctggggcggcggctggggcagcggctgcagcagcggcggacgctctgcattacccagtcttgcgtcctcggcaggcgcccgaagctgagtgcgcatcctctaccgcacccaagcttcgtctgtctcgtcaagctcttcatgctgcccaactaaaaggaaaacatgggcacaggggattttatctgcatttccatgactggaggggcgccctgggggttcagattgcaaggtggcaaggagcagaagcagcccttacaagttgcaaagattcgaaatcagagcaaagcctctgggtctgggctctgtgagggagatgaagtggtttccatcaatggcaacccttgtgcagatctcacctaccctgaagtcatcaagctcatggaaagcataacagactctctccaaatgctcatcaaaagaccatccagtggaataagtgaggctttgatatctgaaaatgaaaacaaaaacctcgagcatctcacacatgggggttatgtggaaagtaccaccctgcagattcgaccggccacaaagacccagtgcacagaattcttcctcgcccctgtcaagactgaagttcccctagctgagaaccaaagaagtggtcccgactgtgcaggcagcttgaaagaagaaacaggcccgagctaccaaagggctccccaaatgcctgactcccaaagaggacgcgtggcagaagagctgatcttaagggagaaggtagaagcggtacagcctgggcctgtggttgagctgcaactgtccctttcacaggagagacataagggcgctagtggccctttagtggctctcccgggagctgaaaaatctaagtctcctgacccagaccctaacttgtcacatgacaggattgtccacataaattcgatccctactaatgagaaagcagaccctttcctgaggtccagcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagaaaaacaagtgaaggaagcaaaatctaaatgcaaaagcattgcccttcttctaacggatgctcccagccccaactccaagggggtgttgatgtttaagaagcgacgtcggagggccaggaaatacaccctagttagctacggtactggcgagcttgagcgagaggcggacgaggaggaagaaggtgacaaggaggatacatgtgaagtagcatttcttggtgcaagcgaatcagaggtggatgaagagttattgtctgacgttgacgacaacacacaagttgtgaactttgactgggattctggactggtggacattgaaaagaaactgaacagaggggacaagatggagatgttaccagacaccacaggcaagggagccctcatgtttgccaagaggagggagagaatggatcagatcacagcccaaaaagaagaggacaaggtaggtggaacgccaagcagagaacaagatgctgcccagaccgatggcctgagaaccacgacttcttaccaaagaaaggaggaagagtcggtaagaacgcagagctctgtgagcaaaagctacatcgaggtgagtcatggtcttggccatgttccccaacagaatggcttcagtggggcatctgagacagcaaacatccagaggatggtccccatgaatagaacggccaaacccttcccagggtctgtgaatcagccagctacccccttctcgccaacccgaaacatgacgagtcccattgctgactttcctgcacctccaccttactctgcagtcactcctccccctgacgccttctccagaggggtttcaagtccgattgctggcccagcacagccccctccatggccccagcctgccccgtggtcccagccagccttttacgattcgtctgagcgaatagcttcccgagatgagaggatctcagtgccagcaaaaagaacaggaatattgcaggaggccaaaaggagaagcacgacaaaacccatgtttacttttaaagagcccaaagtaagcccaaatcctgaactcttgtcactccttcaaaattcagaaggcaaacggggcactggagctggaggtgattccggaccggaagaagactacctcagcttgggggcagaggcttgtaatttcatgcaaagctcctctgccaaacaaaagacccctcctcctgttgctccaaaacctgcagtcaagtcctcatcctcccaaccagtaactccagtttccccagtctggtctccaggagtggctcccacccaacctcctgccttccccacatccaacccatcaaagggcaccgttgtctcctccatcaaaatagcccagccttcttaccctcctgcccggcctgcaagtactttgaacgtggctggtcccttcaaaggaccacaagcagcagtagccagtcagaattacacacccaaaccaacagtttccacaccaacagtcaatgctgttcagcctggtgcagtgggaccatccaatgagcttccaggaatgagtgggagaggagctcagctctttgctaaaaggcagtcgagaatggagaagtatgtggtcgattcagacacggtgcaggcccacgctgctcgagctcagtctcccactccatctctcccggccagttggaagtactcctccaatgtccgagcacctcctcctgtggcctataatcctatccactcgccgtcttacccactggctgctctcaagtctcagccatcagctgcacagccctccaaaatgggcaagaaaaagggaaagaaacccctcaatgcattagatgtcatgaagcaccaaccgtatcagctcaatgcatccttgtttactttccaacctccagatgcaaaggatggcctcccccagaagtcatcagtcaaggtcaattcagccctggccatgaagcaagctcttcctccccggccagtgaatgctgcctcacctacgaatgtgcaggcttcgtcagtgtactcggtaccagcctatacctctcctccttccttctttgcagaggcctcctcaccagtcagtgcatccccagtgcctgtgggcattcccacctcgccaaagcaagaatcagcctcatcatcttattttgtggcaccaaggccaaagttctcagccaagaaaagtggtgtcacaattcaggagagtgggcgctccctttctcttcctggaagatcagtcccaccccccatttctacatctccttgggtataccagcctacttatagttactctagtaaaccaaccgatggactagagaaagcaaacaagagaccaactccttgggaagcagcagcaaagtctcctctcggtctagtggatgatgctttccaacccagaaacatccaggaatccattgtgacaaatgtggtttcagcagctcggaggaaggtgcttccagggcctccagaggattggaatgaaagactgtcctatattcctcaaacccagaaggcctatatgggctcatgtggaaggcaagagtataatgtcacagccaataataatatgtccaccacctcccaatatggttcacagttgccatatgcatattataggcaggcttcaagaaatgattctgcaatcatgtccatggaaaccaggtctgattactgtcttccagtagctgattacaactacaacccacacccaaggggatggagacgccaaacatgaaagttagaagaacggatcatgtgccaactgtagttttttaaaaaaacgctcctttgtagggttttaaacttttctaatagatttagattcacttttggtcttggcttgttctcataagtcatttatctaagtttgtgtttctgtgtgtgtgtatgtgtgtgtatgtatgtgaatatacacacacacacacacaggtaagtgtgaatacttccttgttggctgatccatagagcattactttgaagaaaatttcactatttgcattgatgtgctggcatttatatgtaattcataattttgattccattaataggtagtctatgcaactaaactctactcaattaaagtaaaactaagtatttcttcattgtaccttagtccaggaagaaattaatggaatatggtgtgctaattatcactacctataacatgaggaatataacattgcagaaatttctcataggggcatgccagtgagcaattactttataaaaatattttccttggtgttaagtatttctctgcaacttttttttttttttgagatggagtcttgctctgtcccacccagtctggagtgcaatggtgcgatcttggctcactgcaacctgcgcctcctgggttcaagcaattctcctgcctcagcctcctgaatagctgggattacaggcatgcatcaccacacctggctaatttttgtatttttagtagacacaaagtttcaccatgttggtcagactggtcttgaactcctgacctcgtgatctacccacctcagcctcccaaagtgctgggattacaggcgtgagccaccacacctggcctttctgcaacatttttttaaaaaaatctaataaatcttagatttttaaaaaagaattaaaatgtgggagttctcagaaagaaataaacacatgagaataagattattacacattttggaaggacttttgaggaatgatgtgatgtgtagagaatagaaagatttagatatatgcctgtgacaggaatagattctgggttcaggtgtccccatctgtcaaatgagaagattggattatctaatcttttagatccttaacaactctgatattctgagattctctcatttgtagaatgcccgctgatgcattgtttattttttttgctcataatataaatatcagattatgtttaggagtggattaggtaattagtgtcactacatgtatcgttaaaggtcctaaaaggaattgttaggcggcaggctttgtgttacgtgttacatggagtgagggtagatgtgaagatttaaaacgattgatggatttaaggaagtggtacataaatatgtctgttattatgcaatcgtaggtcatgataatttattcagttatagaaaacatgccacagaagccgatgtaacaagtggtgcttctttagaaagctgtcattaggatgttctgaggaagttaagcagctgcttcatcaatcccatgacacatgccttgttagcatgcccatcaaataatcagatcaaacacctgctccttattgccatacccacgaactgttaaatacaaaaaaattcaaagtatttgacatcttaagcaaatatccagaatatttttaagtaaaaaaccatcttaagtattcaaaatttccttggctttttaaaggtgataattttgctttgtgttacttttttgctcttgaatgtatcgttatgatggtctcttataatcatggtatctttcacagaataaaaattaaaaataatgccagggtgcaagtgaccaaggccttatcttgaaagttaaaaaaaaaaagtaaagaaatcacagtaagttctattagtgatgatagaaccagatataaaattgttcagtgatggagaaaagaaacgataaatactttccaaggttatattgctaaattatcttaaattatcaaggtgtaaggtgtaatgatcccaagagtttttatagaatcctaaaaaataatgcctgatgtatagattagttagcaaattctcagaaatcccccacataaaagccttactttgttcaaaatttattatagtggtttaatcattttagatttgaatgttttaagataggagagacttagcagaaaatacttggcttgccagggccacgttctacttcattgctttcttttataagtgcaaggagttatttccatcagttgacgtagatattattcactaaaattttcagcagactcaaaatagagaggagactttaaacttacatgttagtataaaacagacttctctctcattgcatgcactagatcaatattatcatctgtattaagctatctgaatttattcgagacattaagaaaaagacagtacatggtgggaaagctgcacatttctcacaaggaaaaaaacattctatatttgtagcagaaatcagtggtttgaaaagtcatactttgcagatatgaacctgaaaatcaaagtgccattgttaaatcatcctaaagtgtactgtgggtattcttctccagcatacttgaaaatgaataaagttagattgctcacattgaagctaatggttgagacaagacacccgccagagtgaagtttgattcctatgggtgagaagatgtagatgactattgttctcactaaagttctaaaataatagcaagtgtagagaagagccgttgctttgaaaatacataccacatttgttataaagcatttgtttgttagtagcaatcacataggtagaaagagtttgagttttactgtggattaaaaagccttccctaaaaagagagcatgccagtcatagagacactaatttggcacttttcctccttcttaggtttaaatgttataccaatgcatgtgtttgaaatatctattaagatgatttaaaatttgtcttgtattttgagtttcttaaatgcgtggattcttgttcatttatctctgaatatgtctcttttatattttggcacaattatacacattggaaagggccaacctattagggctcaagtatgtatatgcaaaaaaaaaagttatatcaaacaggcacagttattacaactagagagaaattccagaaatatttgtttttttaagagaaagtaaattttcacattagatttctattcaaagtactaatatctacatggtccacacttttctattttaaaaaattgtgttctcttgttaaatagattaacatttccacttctgtttatcacaaaagactgtatttgaaatatgcatacggaaaattgaaattatattagtaataaatgtaacttgaaaaatcaaaaaaaaaaaaaaaaaagaaaaaaaaaaaaaaaaaa

SEQ ID NO: 27 - DNA, 824 bp, Homo sapiens
gaattcgaatgccaccctcccagatgggggcagagagcaccgcccagcagccagtgggttcccgcgcgtgccgagactctgaggccttgcacccccacgatcccgtacgatggccgtcaagaagatcgcgatcttcggcgccactggccagaccgggctcaccaccctggcgcaggcggtgcaagcaggttacgaagtgacagtgctggtgcgggactcctccaggctgccatcagaggggccccggccggcccacgtggtagtgggagatgttctgcaggcagccgatgtggacaagaccgtggctggccaggacgctgtcatcgtgctgctgggcacccgcaatgacctcagtcccacgacagttatgtccgagggcgcccggaacattgtggcagccatgaaggctcatggtgtggacaaggtcgtggcctgcacctcggctttcctgctctgggaccctaccaaggtgcccccacgactgcaggctgtgactgatgaccacatccggatgcacaaggtgctgcgggaatcaggcctgaagtacgtggctgtgatgccgccacacataggagaccagccactaactggggcgtacacagtgaccctggatggacgagggccctcaagggtcatctccaaacatgacctgggccatttcatgctgcgctgcctcaccaccgatgagtacgacggacacagcacctacccctcccaccagtaccagtagcactctgtccccatctgggagggtggcattctggacatgaggagcaaaggaagggggcaataaatgttgagccaagagcttcaaattactctag

SEQ ID NO: 28 - DNA, 1860 bp, Homo sapiens
agcggagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtggaaaaaaaaaaaaaaaa

SEQ ID NO: 29 - DNA, 2853 bp, Homo sapiens
atgaactccgttagtggcaatgcccccgaagaggcgcaggtgtgtgcacctgtgattaagggtgtcgaggaggggcagcctcatctcttgaagcagaaagtgttgtcacctggtgatgggacagagggaaaagctctggggctgggaaacctgggggcttgtgtcaaagctccacccatcaggagcttcaagagaagatggggggcggggggcggtggctggaaagatggaagttgggatgggaaagcggttgtagaaaaggattcactcctggaccgaaggcaggaggatatcccgggcgagagaagggagggtcggggatgggctgagttggagtcccagaggaaaagcggaagcgagagcttcgtcacccgctgtcttccagctcccgagcagccagccgcccccgggaccgacggctgggggctgccgagcggcggcggaggcgcccaggacgcctggctccggaccccgctggcccccagcgagatgatcacggctcagagcgcgctgccggagagggaagcgcaggagtccagcaccaccgacgaggatctcgcaggccggagagcggccaacgggagcagcgagaggggcggcgccgtcagcacccccgactatggggagaagaagctgccacaggcgctcatcatcggggtcaagaaaggagggacccgcgcgctgctggaggcgatccgcgtgcacccggacgtgcgggcggtgggcgtagagccgcacttcttcgacaggaactacgaaaaggggttggagtggtacagaaatgtgatgcccaagactttggatgggcaaataaccatggagaagactccaagttactttgtgacaaatgaggctcccaagcgcattcactccatggccaaggacatcaaactgattgtggtggtgagaaaccccgtgaccagggccatctctgactacacgcagacactgtcaaagaaacccgagatccccacctttgaggtgctggccttcaaaaaccggaccctcgggctgatcgatgcttcctggagtgccattcgaatagggatctatgcgctgcatctggaaaactggctccagtatttccccctctcccagatcctctttgtcagtggtgagcgactcattgtggaccccgccggggaaatggccaaagtacaggattttctaggcctcaaacgtgttgtgactgagaagcatttctatttcaacaaaaccaaggggttcccttgcctaaagaagccagaagacagcagtgccccgaggtgcttaggcaagagcaaaggtcggactcatcctcgcattgacccagatgtcatccacagactgaggaaattctacaaacccttcaacttgatgttttaccaaatgactggtcaagattttcagtgggaacaggaagagggtgataaatgaggctagagaggcagaggaaggctagtcaataagctaaggaggctccttgcctgagtccttgaataccccagcttctgcagcttcacttgctggagtgccaagtagatctcctcctccttcatgcagccaggattgcctccagtgctgttagcttaggcaaacaggtggatcccatggcatccccatggaggaaccaggcccatctgggcagcagcatctggttgaccagatggccaccagaacccactgttcattcttatcttctgctagttaatatagcctgaagacagaggataaatagttgtcaatgtcagagacagtgctattaatgtatatgtgagcgacaaaaaaggtctgctttataggggttctcactctagcttggggagccagggttctagccctgtatctgtcatgggcacctgctgtctaaacctctgcttgggcttctccccagaatgcactttgtggctgagtgctccaggactcctagggagcaaggtcctccctctaaggtgtttctagtcttctctttaaaggtctcatcccacaacccctgacttcctccctccccacatcatgaaggcagaggcatgcacattcctcactgaaaaagaaaacacacacccacccacacacacacacacagaagaaaatgaaagctgacacacctcgaagccttctttccaagagccctctaaatggggttgggtctcactcttcatgagtatcctgggttgtgcagaagcttagcatatgcccttgtgttcggatcaggcccacagggctgctcaaagagtagagtaattgtaaccgaggtcagagctctggggttggcagagatgagtggccatatctgggggtaaaagaagaaatcctgtcctcttggtgggaggttaccttacctgaagaccatctctcccaagcactgtagttctgagcatgtttttggggtggactctgtcccctagggtccctagaagggcaaagaccagagagttgacaagtctgttattaggaataatccttagccatgtaatggagaaaggagcagtcagcattcttccaatttgccccaccaccacctcctcgggcttcattttctctatttagagatggcagagagtgaggtagtggcgagaaagctgactccattcatcagatccagtttatgagggttgggggtgagcaagggctgtctgcagaaacccccatcaagagctgctgaatgaagtgtcccttcccatcagtttgattcaattaaaatgcatcatttgacataaagcacttgttcacagatctccaaaaccaggaattgttctagtaaaactggaaatttgtatgagtggggggagttaaatctgttcagctgttattaaactgtcatttctcccgctaaatgaaaaccgtgttgttataaagcttaatgcaacctga

SEQ ID NO: 30 - DNA, 1220 bp, Homo sapiens
agccaggctagtgacagaaatggattcgaaatatcagtgtgtgaagctgaatgatggtcacttcatgcctgtcctgggatttggcacctatgcgcctgcagaggttcctaaaagtaaagctttagaggccaccaaattggcaattgaagctggcttccgccatattgattctgctcatttatacaataatgaggagcaggttggactggccatccgaagcaagattgcagatggcagtgtgaagagagaagacatattctacacttcaaagctttggtgcaattcccatcgaccagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccgtggagaagtgtaaagatgcaggattggccaagtccatcggggtgtccaacttcaaccgcaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggtgatttcagcaagctacagcaaagcccattggccagaaaaaaaagacaataattttgttttttcattttgaaaaaattaaatgctctctcctaaagattcttcacctaaaaaa

SEQ ID NO: 31 - DNA, 5106 bp, Homo sapiens
caagggcactgatcattagataagactcctgcttcctcgttgcttacatcgggggtactgacccactaaggccccttgtactgttaatgtgaatatttgcaattatatatgtctccttctggtagagtgggatattatgccctagtatcccctttgcattactgcaggggctgctgactactcaaaacttctcctgggactgttaataggcacaatggcagttatcaatggttttctccctccctgaccttgttaagcaagcgccccaccccacccttagtttcccatggcataataaagtataagcattggagtattccatgcacttgtctatcaaacagtggtccatactcccaacccttttgcattgcgccagtgtgtaaaatcacaggtagccatggtgtcatgctttatatacgaagtcttccctctctctgccccttgtgtgcccttggcccctttttacagactattgctcacaatctcaggtgtccatatttgcagctattaggtaagattgtgctgtctccctcttcccttccctctgccctgccccttttgcctctttgctgggtaatgttgaccagacaaggccctttctcttggacttaaacaattctcagttgcactttccttggtcccacccattatacatgaacccctctacttcctttcgcattgcttctgagtatgctgactacccaaagccccttctgtgttattaataaacacagtactgattgtcccatttttcagcccatcagtccaagatctccctaccactttggtgtgttggtgcagtgttgactatgaaaagcaggcctgaactaggtggataagccttcactcattttctttcatttattaatgatcctagtttcaattattgtcagattctggggacaagaaccattcttgcccacctgtgttactgctttactgtgcaaaatactgaaggcaagtcagacccagggagctggattgccatcctttattttgtgtttccagtgtacactataaaattgtctccccaggaaggaaggttggcactttctctgcattcttctttccagagcagattgcctggttaagaatctcttgttgtcccctttgtatattgttattgtaaagtgccaaatgccaggatacagccagaaaaattgcttattattattaaaaaaatttttttaagaaagacatctggattgtagggtggactcgataacctggtcattatttttttgaagccaaaatatccatttatactatgtacctggtgaccagtgtctctcattttaactgagggtggtgggtctgtggatagaacactgactcttgctattttaatatcaaagatattctagagtggaactcttaagaccagtatctttgtgtgggctttaccagcattcacttttagaaaaactacctaaattttataatcctttaatttcttcatctggagcacctgcccctacttatttcaagaagattgcagtaaaacgattaaatgagggaacatatgcagaggtgcttttaaaaagcatatgccaccttttttattaattattatataaaatgaagcatttaattatagtaataatttgaagtagtttgaagtaccacactgaggtgaggacttaaaaatgataagacgagttccctattttataagaaaaataagccaaaattaaatattcttttggatataaatttcaacagtgagatagctgcctagtggaaatgaataatatcccagccactagtgtacagggtgttttgtggcacaggattatgtaatatggaactgctcaagcaaataactagtcatcacaacagcagttctttgtaataactgaaaaagaatattgtttctcggagaaggatgtcaaaagatcggcccagctcagggagcagtttgccctactagctcctcggacagctgtaaagaagagtctctggctctttagaatactgatcccattgaagataccacgctgcatgtgtccttagtagtcatgtctccttaggctcctcttggacattctgagcatgtgagacctgaggactgcaaacagctataagaggctccaaattaatcatatctttccctttgagaatctggccaagctccagctaatctacttggatgggttgccagctatctggagaaaaagatcttcctcagaagaataggcttgttgttttacagtgttagtgatccattccctttgacgatccctaggtggagatggggcatgaggatcctccaggggaaaagctcactaccactgggcaacaaccctaggtcaggaggttctgtcaagatactttcctggtcccagataggaagataaagtctcaaaaacaaccaccacacgtcaagctcttcattgttcctatctgccaaatcattatacttcctacaagcagtgcagagagctgagtcttcagcaggtccaagaaatttgaacacactgaaggaagtcagccttcccacctgaagatcaacatgcctggcactctagcacttgaggatagctgaatgaatgtgtatttctttgtctctttctttcttgtctttgctctttgttctctatctaaagtgtgtcttacccatttccatgtttctcttgctaatttctttcgtgtgtgcctttgcctcattttctctttttgttcacaagagtggtctgtgtcttgtcttagacatatctctcatttttcattttgttgctatttctctttgctctcctagatgtggctcttctttcacgctttatttcatgtctcctttttgggtcacatgctgtgtgctttttgtccttttcttgttctgtctacctctcctttctctgcctacctctcttttctctttgtgaactgtgattatttgttaccccttccccttctcgttcgttttaaatttcaccttttttctgagtctggcctcctttctgctgtttccactttttatctcacatttctcatttctgcatttcctttctgcctctcttgggctattctctctctcctcccctgcgtgcctcagcatctcttgctgtttgtgattttctatttcagtattaatctctgttggcttgtatttgttctctgcttcttccctttctactcacctttgagtatttcagcctcttcatgaatctatctccctctctttgatttcatgtaatctctccttaaatatttctttgcatatgtgggcaagtgtacgtgtgtgtgtgtcatgtgtggcagaggggcttcctaacccctgcctgataggtgcagaacgtcggctatcagagcaagcattgtggagcggttccttatgccaggctgccatgtgagatgatccaagaccaaaacaaggccctagactgcagtaaaacccagaactcaagtagggcagaaggtggaaggctcatatggatagaaggcccaaagtataagacagatggtttgagacttgagacccgaggactaagatggaaagcccatgttccaagatagatagaagcctcaggcctgaaaccaacaaaagcctcaagagccaagaaaacagagggtggcctgaattggaccgaaggcctgagttggatggaagtctcaaggcttgagttagaagtcttaagacctgggacaggacacatggaaggcctaagaactgagacttgtgacacaaggccaacgacctaagattagcccagggttgtagctggaagacctacaacccaaggatggaaggcccctgtcacaaagcctacctagatggatagaggacccaagcgaaaaaggtatctcaagactaacggccggaatctggaggcccatgacccagaacccaggaaggatagaagcttgaagacctggggaaatcccaagatgagaaccctaaaccctacctcttttctattgtttacacttcttactcttagatatttccagttctcctgtttatctttaagcctgattcttttgagatgtactttttgatgttgccggttacctttagattgacagtattatgcctgggccagtcttgagccagctttaaatcacagcttttacctatttgttaggctatagtgttttgtaaacttctgtttctattcacatcttctccacttgagagagacaccaaaatccagtcagtatctaatctggcttttgttaacttccctcaggagcagacattcatataggtgatactgtatttcagtcctttcttttgaccccagaagccctagactgagaagataaaatggtcaggttgttggggaaaaaaaaagtgccaggctctctagagaaaaatgtgaagagatgctccaggccaatgagaagaattagacaagaaatacacagatgtgccagacttctgagaagcacctgccagcaacagcttccttctttgagcttaggtgagcaggattctggggtttgggatttctagtgatggttatggaaagggtgactgtgcctgggacaaagcgaggtcccaaggggacagcctgaactccctgctcatagtagtggccaaataatttggtggactgtgccaacgctactcctgggtttaatacccatctctaggcttaaagatgagagaacctgggactgttgagcatgtttaatactttccttgatttttttcttcctgtttatgtgggaagttgatttaaatgactgataatgtgtatgaaagcactgtaaaacataagagaaaaaccaattagtgtattggcaatcatgcagttaacatttgaaagtgcagtgtaaattgtgaagcattatgtaaatcaggggtccacagtttttctgtaaggggtcaaatcataaatactttagactgtgggccatatggtttctgttacatatttgttttttaaacaacgtttttataaggtcaaaatcattcttagtttttgagccaattggatttggcctgctgttcatagcttaccaccccctgatgtattatttgttattcagagaaaatttctgaatactactagtttccttttctgtgcctgtccctgtgctaggcactaaaaatgcaatgattattgatatctaggtgacctgaaaaaaaaaaaaaaaaaaaca

SEQ ID NO: 32 - DNA, 1302 bp, Homo sapiens
atgtgtttttctcccattctggaaatcaacatgcagtctgaatctaacattacagtgcgagatgacattgatgacatcaacaccaatatgtaccaaccactatcatatccgttaagctttcaagtgtctctcaccggatttcttatgttagaaattgtgttgggacttggcagcaacctcactgtattggtactttactgcatgaaatccaacttaatcaactctgtcagtaacattattacaatgaatcttcatgtacttgatgtaataatttgtgtgggatgtattcctctaactatagttatccttctgctttcactggagagtaacactgctctcatttgctgtttccatgaggcttgtgtatcttttgcaagtgtctcaacagcaatcaacgtttttgctatcactttggacagatatgacatctctgtaaaacctgcaaaccgaattctgacaatgggcagagctgtaatgttaatgatatccatttggattttttcttttttctctttcctgattccttttattgaggtaaattttttcagtcttcaaagtggaaatacctgggaaaacaagacacttttatgtgtcagtacaaatgaatactacactgaactgggaatgtattatcacctgttagtacagatcccaatattctttttcactgttgtagtaatgttaatcacatacaccaaaatacttcaggctcttaatattcgaataggcacaagattttcaacagggcagaagaagaaagcaagaaagaaaaagacaatttctctaaccacacaacatgaggctacagacatgtcacaaagcagtggtgggagaaatgtagtctttggtgtaagaacttcagtttctgtaataattgccctccggcgagctgtgaaacgacaccgtgaacgacgagaaagacaaaagagagtcttcaggatgtctttattgattatttctacatttcttctctgctggacaccaatttctgttttaaataccaccattttatgtttaggcccaagtgaccttttagtaaaattaagattgtgttttttagtcatggcttatggaacaactatatttcaccctctattatatgcattcactagacaaaaatttcaaaaggtcttgaaaagtaaaatgaaaaagcgagttgtttctatagtagaagctgatcccctgcctaataatgctgtaatacacaactcttggatagatcccaaaagaaacaaaaaaattacctttgaagatagtgaaataagagaaaaacgtttagtgcctcaggttgtcacagactag

SEQ ID NO: 33 - DNA, 458 bp, Homo sapiens
aactgtataagctgagaattttaatttaaagaagaccaaaattggtagtgtccccatgtctgatggaaacaaacacaaattctcccatgaagaatttacatttagggccttgaataatttgcatatagttttaatgagcataaagtcacacacatacataaacatcatgaaaaatataggggaataaagcaccattagcaagagtcagcagaaacaatagaaatatttataaagattattagattactggaactatcagatacagaatataaagctgtttgatatgtttacataaataaatgaaaaaaattttaaacataattataattcataaccaccaaatgacaatgcatttttggaaaaacaacaaatataataattaaaattggaaaacttaatggagctttgccttttggactagcatagcagccattactccaccataacttagggagtaa

SEQ ID NO: 34 - DNA, 315 bp, Homo sapiens
attatttatttacatatacaacacttgtgaaaagggcgctagataagtagaacaagaagcccagtttctggtacatcctgctctcagtcacctctaggtctctggaacttgaaagctatgtctcttcttgcagggttctgttacaatccattgattttccctcacggtataaagttccctttgcttaagtttcactggactatttcccccaaggtcattctgacaaatgatgttctttgttgtttatactgttcaataagatttcattttgaagaacatgatgaatcatgtgacgacattcttcccgttattgaa

SEQ ID NO: 35 - DNA, 1743 bp, Homo sapiens
ggtgttgttccggacacatagaaagataacgacgggaagagcggggcccgctttggggtccaggcaggttttggggcctcctgtctggtgggaggaggccgcagcgcagcaccctgctcgtcacttgggatggagaccggctttcccgcaatcatgtaccctggatcttttattgggggctggggagaagagtatctcagctgggaaggaccggggctcccagatttcgtcttccagcagcagcccgtggagtctgaagcaatgcactgcagcaaccccaagagtggagttgtgctggctacagtggcccgaggtcccgatgcttgtcagatactcaccagagccccgctgggccaggatcccccgcagaggacagtgctagggctgctaactgcaaatgggcagtacaggaggacctgtggccaggggatcacaagaatcaggtgttattctggatcagaaaatgccttccctccagctggaaagaaagcactccctgactgtggggtccaagagccccccaagcaagggtttgacatctacatggatgaactagagcagggggacagagacagctgctcggtcagagaggggatggcatttgaggatgtgtatgaagtagacaccggcacactcaagtcagacctgcacttcctgctggatttcaacacagtttcccctatgctggtagattcatctctcctctcccagtctgaagatatatccagtcttggcacagatgtgataaatgtgactgaatatgctgaagaaatttatcagtaccttagggaagctgaaataaggcacagacccaaagcacactacatgaagaagcagccagacatcacggaaggcatgcgcacgattctggtggactggctggtggaggttggggaagaatataaacttcgagcagagaccctgtatctggctgtcaacttcctggacaggttcctttcatgtatgtctgttctgagagggaaactgcagctcgtaggaacagcagctatgcttttggcttcgaaatatgaagagatatatcctcctgaagtagacgagtttgtctatatcaccgatgatacatacacaaaacgacaactgttaaaaatggaacacttgcttctgaaagttctagcttttgatctgacagtaccaaccaccaaccagtttctccttcagtacttgaggcgacaaggagtgtgcgtcaggactgagaacctggctaagtacgtagcagagctgagtctacttgaagcagatccattcttgaaatatcttccttcactgatagctgcagcagctttttgcctggcaaactatactgtgaacaagcacttttggccagaaacccttgctgcatttacagggtattcattaagtgaaattgtgccttgcctgagtgagcttcataaagcgtaccttgatataccccatcgacctcagcaagcaattagggagaagtacaaggcttcaaagtacctgtgtgtgtccctcatggagccacctgcagttcttcttctacaataagtttctgaatggaagcacttccagaacttcacctccatatcagaagtgccaataatcgtcataggcttctgcacgttggatcaactaatgttgtttacaatatagatgacattttaaaaatgtaaatgaatttagtttcccttagactttagtagtttgtaatatagtccaacattttttaaacaataaactgcttgtcttatgacaaaaaaaaaa

SEQ ID NO: 36 - DNA, 1909 bp, Homo sapiens
ggaaaaaagctaccgtggcacgtgccccggggagtgatgcggtggcccggtttgcacggagagcgggacaccgcctggggagccgcgctcgtagcctgggggcgggacgcggcggccgctccctccgcccccgagtagctgccaccgcctggctgcgccccagcccagtagctcagacgcggccgcatcccggtggactgtagaggcggcagcgagctagagcccgagtcgcagctccgggccgcagagcgctgggcgagcgcgagcgccagggcaccggcagggcaggcagctgcgcgcggctggagtcatgctatactgaaaagacacttcatcaagataactctgggagaagcagaaaaccctgtgccagggacaggaaagataggagaaagaaagtttatcagaattttttaaacctgtctcagaaataacaacatattttaatcagagatttatgttgctatgaggacagattcatcaaaaatgactgacgtggagtctggggtcgccaattttgcatcttcagcaagggcaggccgccggaatgccttaccagacatccagagttcagctgccacagacggaacctcagatttgcccctcaaactggaggctctctccgtgaaggaagatgcaaaagagaaagatgaaaaaacaacacaagaccaattggaaaagcctcaaaatgaagaaaaatgaaggctcataatctatcaagagtgctgaatttctgcatgttgaaagacttagtggttctgttttcttgagacatttaatctggtggtaactgtggtaacattgcagccctaagcagcatgtgtatattagataattgtgttgtgatgctactcactttgattgcaatgatgatgtccaaggtaagctattaaaaggcaggttacttccaaatcgcactgaaggaaaaggttaagaataatacatgatcacagaaatgcataccactgtctgtaaacccaacaaaattcactgttctcttttggatttatttagcctgatgtatttttaattcaatttttatggtgatgggcaaatcattcttggtaaatgtaaatcaaacatgattgatttaaaacttcatggaatttgtagaaaattatggacatttttggtgagaaagaacaatagtcaaaactcacatggatagagtgtgtttgttttttgccaaaaatgccccagactttttcccaaacctcaaaaacgtcttggaaaaattgtaaaagtttgataacagaaacatctttaggatatttttgtctgacatattttgcttctagtatgtgcctactgtgatttttttcatgtggaaaatgcaaaatttgtaacaaaatggttatatggaacatgcctattaaatgaattttactatcttccctaactttggtctgtgtatgtgtgtgtgttttactttaatatgaattatacaaaatactagttgttttacactctcttttcttattcttagggcttttgtgtatgtctgacttgtttttaaataacttcctcagcaatgcagaccttaatttttatatttttttaaagtagctaacatagcagtaggcacttaagcatttagtcaatgatattggtagaaatagtaaaatacatcctttaaatatatatctaagcatatattttaaaaggagcaaaaataaaaccaaagtgttagtaaattttgatttattagatattttagaaaaataatagaattctgaagttttaaaaatgtcagtaattaatttattttcattttcagaaatatatgcatgcagttatgttttatttgattgttgacttaggctatgtctgtatacagtaaccaaataaactctttcactattaaagagatttcttactgaaaaaaaaaaaaaaaaaaaaaaaaaaaaaa

SEQ ID NO: 37 - DNA, 552 bp, Homo sapiens
ttttggctgtcgtgactggagggaagtggtgctcctacatctaatgcgaggaggacagaggtgctgctaaacatcattcccacacaggacagcctcccgcaacaaagaattgcctggtccaaaatgggtgggaaagcctgacttagaggcttagggagttttcccctcctgctaaatgacttgaagcgattgccacatgggttacacataaaatgtgtccatggcatacagttctgactgtaaaatgagcgtcactcaatggtgacaggaaactggaagcactgttaaaatgggaagatatgaaccaatccttatctacatgacacctacacatctagaactttacgaatttctctcatgggctcctggatctggacatttacatgatgccaggcatatagctgtgtggcttcttgcaggcaaaattcccaagtgattgactacatctcttatttttcttccaggtgtttgtgtacagtttaagcaatcacagtctctgcgtagaaagatcttctcaaatatactactgcaaaaagcaaaaaaaaaaaaaaa

SEQ ID NO: 38 - DNA, 263 bp, Homo sapiens
aattgctattctttattttgccactcaaaataattaccaaaaaaaaaaaatcttaaatgataacaacacaacatcaaggcaaagagaacaggaatggctgactctgcataaattggccgaagattatccattatcttaaggtttgacttcaggttacagcacacagacaaacgtgcccaggaggctctcaggaccgctcgatgtcttctgaggaggctgcggcggggagatccaggaggcggtcgagggcaccggcctctttg

SEQ ID NO: 39 - DNA, 1579 bp, Homo sapiens
  misc_feature (34)..(34): n is a, c, g, or t
  misc_feature (45)..(45): n is a, c, g, or t
  misc_feature (303)..(303): n is a, c, g, or t
  misc_feature (367)..(367): n is a, c, g, or t
  misc_feature (446)..(446): n is a, c, g, or t
  misc_feature (629)..(629): n is a, c, g, or t
  misc_feature (631)..(631): n is a, c, g, or t
  misc_feature (637)..(637): n is a, c, g, or t
  misc_feature (643)..(643): n is a, c, g, or t
  misc_feature (645)..(646): n is a, c, g, or t
  misc_feature (657)..(657): n is a, c, g, or t
cggggggtgtgtctgcaggtacgagtttaatacnactcactatanggaatttgggcctcgaggggcaagaaattcggcacgaggattgacacggatgcctacacctaggtttatttattaaaagcgcttttttacattccttgcaatactgatggtgatgatgcgcaggtctcattggtttcattcttgcagttgccatacagtgcctttccatttatttaacccccacctgaacggcataaactgagtgttcagctggtgttttttactgtaaacaataaggagactttgctcttcatttanaccaaaatcatatttcatattttacgctcgagggtttttaccggttcctttttacactccttanaacagtttttaagtcgtttggaacaagatattttttctttcctggcagcttttaacattatagcaaatttgtgtctggnggactgctggtcactgtttctcacagttgcaaatcaaggcatttgcaaccaagaaaaaaaaaattttttgttttatttgaaactggaccggataaacggtgtttgagcggctgctgtatatagttttaaatggtttattgcacctccttaagttgcacttatgtgggggggttgggggtgganangttttntatcananngtcacaggganttttttcttttgttactggactaaaacgggctgcttttcggtggggggaagattcaaggttcacagggtccctttctcctaaatggggggaaggtccccctccccttataagcttttaatttgtgggaaatgtgtgacgtgtaactagttgtgcatttttacagtgcatatgtcccactgtgggatttgtgagaaacccgggcgcgtttgtttgtctccataccgattgtctgttgggcttggcctccgtctttgtgctggcactggcatcttctcttgtcctcctaaactttacccctgtcttttctcccccgtctccctggcgtatgatcttgtcttctctgccgatggcaacgccaagtggttcgatgtcatcgcccgcgtccctcctgtgcgttgagcacaggttgcgcgtcttgtcagtaggtgtggcgacattcctcctcatctgtatagctttcttatattgttttttgtgcggggactctgtggtatgtcttaacatcctttcatcatctcacattggtggcggttgcagctgcctcgcacaccgccttgtctccttctcttctgaccagcttgtgctgtaggtgctattggtctcggtgtcgcctttcttacttctttgctcagaccgcgctgtgctgtttctttgctgtgcctcggaacatgtgtcttcgtgctcattctcctctcactgccacgtcgtcatgcggcggcctccttactctgcttctgtgtcttgacttctgcttcttgcttcctgtgcctgtgcgcttactgggtacgtggcgtctatctgtttcgcatctcgcacggatatgtatggcccctgcggcgtttgtcttgttgtgtgatgtgtggctgtgctcgtgctctctgcctttgctctcgtcgggcttggtcgttgctgctgtctgtg

SEQ ID NO: 40 - DNA, 1243 bp, Homo sapiens
  misc_feature (8)..(9): n is a, c, g, or t
  misc_feature (11)..(11): n is a, c, g, or t
  misc_feature (19)..(19): n is a, c, g, or t
  misc_feature (592)..(592): n is a, c, g, or t
  misc_feature (649)..(650): n is a, c, g, or t
agagtcanntntgtgtggncgtacggttgtaaagacggccagtgccaagctaaaattaaccctcactaaagggaataagcttgcggccgcgattttttttttttttttttttaatgtataaatccatttatataaagttcaaaaacaggcaaaatgaatcaaaggtgatgaaactcagaaaaactgctatgtttgggaggtaatggctgagaaaaggcaggaatgaggctgtgaagtgttgccaatattctacatcttcactttggcagtggttacacaggtgttcacgacataaatatctatcagactgtatacagttttgtccactttttgtatgcatggtatacttcagtaaaagtttactaaaaaataaaaataaaaaagacattgtgcttcttgttaccaaaataaaaccatggcagatattttggtaaatattctatttttcccatcttctactgttgctgatgacagggatggtattcaggtgaacactttgtcacttagaatatcatttagctttagcctgtgcagccaatgcagcttcttcacgccacttagcttttcttgccaaagttccaacttggttaanggattcatggtcgtttctacaagccccttttgggcttggacactattcaccaggcannagccaaggcggagttaatttggttgaaggtcccaaatttcattttaattgttttaccaaaggccctttttcaaccttcgaaaagccctttttggttttccctttttggcgggggggggtcctaaaacaaaatttttcccgtggggggggggggatatcctccgaaggggcgcggggggaatttctccccccccccaaaaccgacatttttttgggaaacagcccccccggtgtccaaaaaaagaaaggggatattttcttcttgtgtccaaaaatttcgaaaaagggctcttcgtccttgcgcgtggggaaaccccgcggaaaactcccccccggtgaccttttgtgcgccacaaatttttgttggggcccccgcccccttggatttaaaaaggggaaaacccccgggggggaagaaacccggggagggccccgcccgtggcccgtaaaagtgccccgcgcggtgcaggtgcttttgcccgggcccgtcatttttattgtcgctggccttttctttttgtttgcgcgctgcttccttcttcccccgcgctagggagaaggagagaggaccgtgaagggcccgggcgatgtttc

SEQ ID NO: 41 - DNA, 782 bp, Homo sapiens
agatgataatcatatagggcgctaggctgagcagcgaacgaccgagcgcagcgagtagtgagcgaggaagcgggcgcataacttcgtatagcatacattatacgaagttatcagtcgacggtaccggacatatgcccgggaattcggccattacggccggggggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaaggccctggtccctctgcagtctctataccaataaagtgaccctgctcccaaaaaaaaaaaaaaaaaaaaaaaaaaaaactttgggggcgcccgcccggcgcccccgaaaaagtttttaacacctccggtggggggccgcggggcccccaggcgaacggaacaggggcctctcccgggcccccacaagaaaccacccgggcgcaaggacaaagcgggctggggcattccaccaccatcataaacaacaccccccggggagaacaaccagagtcgttttccggacaaaaactcaaagacgggaggctacgcgaggagcccaacagcgggcagcctaacccaccggggagtcccaaccgaacccacgaaattcaaaaattagccccgcgcatcgtgaggccaccactacacccacctaacaaacactccaaccccacacacgcgcgcacaccaccaccactcgcgtcac

SEQ ID NO: 42 - DNA, 1191 bp, Homo sapiens
  misc_feature (1119)..(1119): n is a, c, g, or t
ctaggtgacactatagaacaagtttgtacaaaaaagcaggctggtaccggtccggaattcccgggatgtgccacccactgacacttccctgtaactgacttatacctgcaggttttcccaagcccaacctgatacaatccaatcttaaaatatactagtcaaaatgctttcctggcctacacattgaaaagttctaatacatacagcagttataacatatgccaggcactgcattaggcagctttgcacatcactgacaatttgcaaaaggccagtaaatcttatggtagtagcccttgttttcaaatgggggaaaacaggcttgcctcaaagtgagaccagttggtgaaactgattccaaactccagaaaaaatgctgatttttttccccatggttctcctacctaaatgattggtttccctatggctatttctccaagagttaagggatagctgcttaactatgcacctttacagaacattcttagcagtaatgctcaaatttaaaaggcacactcaagatacttccatgtcatggatccttccccaggtcccagtagtataaatatagggaagaggttagcatgaacttacaaattgttttaagtaatcctcttgaatgccagtcattaaaggactttgcccttctacatcaaattacatccttttcacaaatccccatttctgtaataactggtgcaacctaaaggtgctttatagttttactactttgcagatttgcaatgctgcatataatgcagaagagcattaaaaacttttgtaaaaactcatgattttgatacttttaaagtagcgtttatatgtaaatagaactacacatggcacacacacttgcacaagggcttcagaaaaacgtgcaatataggtgagaaaaatgtctattgaaactttctcacaggctgcccytataatwaactagtgttggggsagcamatctgtttcaagtwgrtyaggggtagcaaaccmaaaggsgcmagcgcctbsvgtttcccaatcctaaaaaaaatggtcwaaamatstttwmawkdcttaaagggattttkaaaaaaaargtttkggggattggggaaaaaaaaaatttccccbgkaaaaaaatanavssggggggggggggggggggggggggggggggaaaaaaaaaaaaaaggggggggkgwdtbtggggggggt

SEQ ID NO: 43 - DNA, 1878 bp, Homo sapiens
gggcgcagcggggcccgtctgcagcaagtgaccgacggccgggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcgtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatgggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcagagaacagcagcagcgaccagaggcaggcctgtaagaagcacgagctgtatgtcagcttccgagacctgggctggcaggactggatcatcgcgcctgaaggctacgccgcctactactgtgagggggagtgtgccttccctctgaactcctacatgaacgccaccaaccacgccatcgtgcagacgctggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatg

SEQ ID NO: 44 - DNA, 2096 bp, Homo sapiens
ggcgggatctgcagttcggactccgcgcgccacagtcgctgcagttcgctccactctggtggccccgccgccctgcggggatcccgggggtcggcgggctgctcggacttggcgcggggccggcccggcctctctcttcctcggtggggcctagacggtcggggcaccgggaacatggagccctctccagccgctgggggcttggagaccactcgcctggtgagcccccgggaccgcggtggcgccggaggcagcctgcgtttgaagagtctcttcacagagccctcagagcccctccctgaggagtccaaacctgtggagatgcccttccaccactgccacagggacccccttccgccgccgggccttacccctgagaggctgcatgcacggaggcagctatatgctgcctgtgccgtttgctttgtcttcatggctggggaggtggtcggcgggtatctggcacacagcctggccatcatgaccgatgcagcccacttgctggcggatgtgggcagcatgatgggcagcctcttctccctctggctctccacccgtccagccacccgcaccatgacctttggctggcaccgttcagagactctgggggctttggcctctgtggtctccctctggatggtcactggcatcctcctgtacctggccttcgtccgcctgctgcacagcgactaccacatcgaggggggtgccatgctgctgaccgccagcatcgcagtctgtgccaacctgttaatggcctttgtgctgcaccaggctgggcccccccacagccacgggtctaggggagcagagtatgcaccgctggaggaggggcctgaagagcccctgcccctggggaacaccagcgtccgggcggcatttgtgcacgtgctgggggacctcctgcagagctttggggtactggctgcctccatcctcatctacttcaagcctcaatacaaggcagccgaccccatcagcaccttcctcttctccatctgtgcccttggatccaccgctcccaccctccgagacgttcttcgaatcctcatggaaggtaccccccgcaatgtggggttcgaacctgtgcgggatacgctgttgtcggtgccaggagtccgggcaacccatgagctgcacctgtgggcccttacgctcacttaccatgttgcctctgcacacctggccatcgactccaccgctgaccctgaagccgtcctggctgaagcctcatcccggctctactcccggtttggattctccagctgcaccctgcaggtcgagcagtatcagccggagatggcccagtgcctgcgctgccaggaacccccccaagcctgagccatggccctgccctcaccccactgccaggccgaggctcagccccagactctcagcatctgctgccctgatcacagagacgggaccgagccaggtccataccccttcctctctccctcctaccacctgccagtttccccagcctcagccccagccccagccccagtgggcaagaccaaagtgtggcggggagtggggtgggagtcaggggaatagatgtgactagttcaggggcggggactcccaggcctcagtgtggcagggtgtgttgaaggcctgtggtgccatctccccatggttcatgtggagccacgaacatcctttccctgcagtccatttgtctgtgtggcaggctggctggctgggggcatctgcctgtctatgtgctgttggtgtgcctatgcctgggggaggtcagtaggggccccctccccacatggccctcgctctgtctatgcaggggccccaaagcccgcactttgtccgtgtgtcttagccctgtggttttgtctgtgtgtgtgtgtgtgtgtgtgtgtgtgtgtgtgtgtgtgttcttggtgctgtggcctgtgtgtctctgtgcctatgtggctgtgctatggtttctatgagtctgctccatccatgtgtctgtttgggggtctatctctccatccctctgttggtgctgtgcccttggctatccctgaaagagggaggactccgctgcagctccaccaataaacttgtgtctcactgcaaaaaaaaaaaaaaaa

SEQ ID NO: 45 - DNA, 7475 bp, Homo sapiens
acttcagacgccgctgatccgggaggagctggggtgagccgcggcggccgtctctcccacccgcagcagcatcctctctgcccttctctgccaccccggggagagccgggagctgcctctttacagcttccacgagccaggggtgcaggcagctgcccccaggaagtttgggcttctgcgtagtttaggggtgcctgcgagcgccccagagggcgaggggccgagggcgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccatacttcgggatgacttcagacaaaacccttcggatgtcatggttgcagtaggagagcctgcagtaatggaatgccaacctccacgaggccatcctgagcccaccatttcatggaagaaagatggctctccactggatgataaagatgaaagaataactatacgaggaggaaagctcatgatcacttacacccgtaaaagtgacgctggcaaatatgtttgtgttggtaccaatatggttggggaacgtgagagtgaagtagccgagctgactgtcttagagagaccatcatttgtgaagagacccagtaacttggcagtaactgtggatgacagtgcagaatttaaatgtgaggcccgaggtgaccctgtacctacagtacgatggaggaaagatgatggagagctgcccaaatccagatatgaaatccgagatgatcataccttgaaaattaggaaggtgacagctggtgacatgggttcatacacttgtgttgcagaaaatatggtgggcaaagctgaagcatctgctactctgactgttcaagaacctccacattttgttgtgaaaccccgtgaccaggttgttgctttgggacggactgtaacttttcagtgtgaagcaaccggaaatcctcaaccagctattttctggaggagagaagggagtcagaatctacttttctcatatcaaccaccacagtcatccagccgattttcagtctcccagactggcgacctcacaattactaatgtccagcgatctgatgttggttattacatctgccagactttaaatgttgctggaagcatcatcacaaaggcatatttggaagttacagatgtgattgcagatcggcctcccccagttattcgacaaggtcctgtgaatcagactgtagccgtggatggcactttcgtcctcagctgtgtggccacaggcagtccagtgcccaccattctgtggagaaaggatggagtcctcgtttcaacccaagactctcgaatcaaacagttggagaatggagtactgcagatccgatatgctaagctgggtgatactggtcggtacacctgcattgcatcaacccccagtggtgaagcaacatggagtgcttacattgaagttcaagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaagatgtcctaccaacaagtcagggggtggaccacaagcaggtccagagagagctgggaaatgctgttctgcacctccacaaccccaccgtcctttcttcctcttccatcgaagtgcactggacagtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaagcacccagtgccccaccccaaggtgtaactgtatccaagaatgatggaaacggaactgcaattctagttagttggcagccacctccagaagacactcaaaatggaatggtccaagagtataaggtttggtgtctgggcaatgaaactcgataccacatcaacaaaacagtggatggttccaccttttccgtggtcattccctttcttgttcctggaatccgatacagtgtggaagtggcagccagcactggggctgggtctggggtaaagagtgagcctcagttcatccagctggatgcccatggaaaccctgtgtcacctgaggaccaagtcagcctcgctcagcagatttcagatgtggtgaagcagccggccttcatagcaggtattggagcagcctgttggatcatcctcatggtcttcagcatctggctttatcgacaccgcaagaagagaaacggacttactagtacctacgcgggtatcagaaaagtcccgtcttttaccttcacaccaacagtaacttaccagagaggaggcgaagctgtcagcagtggagggaggcctggacttctcaacatcagtgaacctgccgcgcagccatggctggcagacacgtggcctaatactggcaacaaccacaatgactgctccatcagctgctgcacggcaggcaatggaaacagcgacagcaacctcactacctacagtcgcccagctgattgtatagcaaattataacaaccaactggataacaaacaaacaaatctgatgctccctgagtcaactgtttatggtgatgtggaccttagtaacaaaatcaatgagatgaaaaccttcaatagcccaaatctgaaggatgggcgttttgtcaatccatcagggcagcctactccttacgccaccactcagctcatccagtcaaacctcagcaacaacatgaacaatggcagcggggactctggcgagaagcactggaaaccactgggacagcagaaacaagaagtggcaccagttcagtacaacatcgtggagcaaaacaagctgaacaaagattatcgagcaaatgacacagttcctccaactatcccatacaaccaatcatacgaccagaacacaggaggatcctacaacagctcagaccggggcagtagtacatctgggagtcaggggcacaagaaaggggcaagaacacccaaggtaccaaaacagggtggcatgaactgggcagacctgcttcctcctcccccagcacatcctcctccacacagcaatagcgaagagtacaacatttctgtagatgaaagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccacatgcagcaccagcccgacaggagacggcagcctgtgagtcctcctccaccaccacggccgatctcccctccacatacctatggctacatttcaggacccctggtctcagatatggatacggatgcgccagaagaggaagaagacgaagccgacatggaggtagccaagatgcaaaccagaaggcttttgttacgtgggcttgagcagacacctgcctccagtgttggggacctggagagctctgtcacggggtccatgatcaacggctggggctcagcctcagaggaggacaacatttccagcggacgctccagtgttagttcttcggacggctcctttttcactgatgctgactttgcccaggcagtcgcagcagcggcagagtatgctggtctgaaagtagcacgacggcaaatgcaggatgctgctggccgtcgacattttcatgcgtctcagtgccctaggcccacaagtcccgtgtctacagacagcaacatgagtgccgccgtaatgcagaaaaccagaccagccaagaaactgaaacaccagccaggacatctgcgcagagaaacctacacagatgatcttccaccacctcctgtgccgccacctgctataaagtcacctactgcccaatccaagacacagctggaagtacgacctgtagtggtgccaaaactcccttctatggatgcaagaacagacagatcatcagacagaaaaggaagcagttacaaggggagagaagtgttggatggaagacaggttgttgacatgcgaacaaatccaggtgatcccagagaagcacaggaacagcaaaatgacgggaaaggacgtggaaacaaggcagcaaaacgagaccttccaccagcaaagactcatctcatccaagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatac

SEQ ID NO: 46 - DNA, 3769 bp, Homo sapiens
ggggtcctgcagcctcccgagtgcggagaggcggggccgcccgctgccgcccggctgcctgcgccccctcccgcggccccggctctgggagcggggcgccccgcgcgcgggcacacggcggccagagcgccgaggcggtaccttcagcctgcaatgagaggaacccgggagagcccccgggagccagcgaagagcttggctgctgcgtccagggctgctgctgccgccgcggctgcttgaaactcctcaaagttgagagccggctagagggtgccgcccgccgggagccggagggaaaggaagtcgggaggtgcaagagtgacagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgccccaccgcttgcatctgtgccactgacatcgtcagctgcaccaacaaaaacctgtccaaggtgcctgggaaccttttcagactgattaagagactggacctgagttataacagaattgggcttctggattctgagtggattccagtatcgtttgcaaagctgaacaccctaattcttcgtcataacaacatcaccagcatttccacgggcagtttttccacaactccaaatttgaagtgtcttgacttatcgtccaataagctgaagacggtgaaaaatgctgtattccaagagttgaaggttctggaagtgcttctgctttacaacaatcacatatcctatctcgatccttcagcgtttggagggctctcccagttgcagaaactctacttaagtggaaattttctcacacagtttccgatggatttgtatgttggaaggttcaagctggcagaactgatgtttttagatgtttcttataaccgaattccttccatgccaatgcaccacataaatttagtgccaggaaaacagctgagaggcatctaccttcatggaaacccatttgtctgtgactgttccctgtactccttgctggtcttttggtatcgtaggcactttagctcagtgatggattttaagaacgattacacctgtcgcctgtggtctgactccaggcactcgcgtcaggtacttctgctccaggatagctttatgaattgctctgacagcatcatcaatggttcctttcgtgcgcttggctttattcatgaggctcaggtcggggaaagactgatggtccactgtgacagcaagacaggtaatgcaaatacggatttcatctgggtgggtccagataacagactgctagagccggataaagagatggaaaacttttacgtgtttcacaatggaagtctggttatagaaagccctcgttttgaggatgctggagtgtattcttgtatcgcaatgaataagcaacgcctgttaaatgaaactgtggacgtcacaataaatgtgagcaatttcactgtaagcagatcccatgctcatgaggcatttaacacagcttttaccactcttgctgcttgcgtggccagtatcgttttggtacttttgtacctctatctgactccatgcccctgcaagtgtaaaaccaagagacagaaaaatatgctacaccaaagcaatgcccattcatcgattctcagtcctggccccgctagtgatgcctccgctgatgaacggaaggcaggtgcaggtaaaagagtggtgtttttggaacccctgaaggatactgcagcagggcagaacgggaaagtcaggctctttcccagcgaggcagtgatagctgagggcatcctaaagtccacgagggggaaatctgactcagattcagtcaattcagtgttttctgacacaccttttgtggcgtccacttaatttgtgcctatatttgtatgatgtcataatttaatctgttcatatttaactttgtgtgtggtctgcaaaataaacagcaggacagaaattgtgttgttttgttctttgaaatacaaccaaattctcttaaaatgattggtaggaaatgaggtaaagtacttcagttcctcaatgtgccagagaaagatggggttgttttccaaagtttaagttctagatcacaatatcttagcttttagcactattggtaatttcagagtaggcccaaaggtgatatgactcccattgtccctttatttaggatattgaaagaaaaaataaactttatgtattagtgtcctttaaaaatagactttgctaacttactagtaccagagttattttaaagaaaaacactagtgtccaatttcatttttaaaagatgtagaaagaagaatcaagcatcaattaattataaagcctaaagcaaagttagatttgggggttattcagccaaaattaccgttttagaccagaatgaatagactacactgataaaatgtactggataatgccacatcctatatggtgttatagaaatagtgcaaggaaagtacatttgtttgcctgtcttttcattttgtacattcttcccattctgtattcttgtacaaaagatctcattgaaaatttaaagtcatcataatttgttgccataaatatgtaagtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagcaaatctctctccaaaattcttatagtaaagttgatttttttaaagggggaggggaaggctttaatgtgttctagatcaatttataccttccgtatgacgttttactctgatatcattgtgcactttagccagatccagaaaacactcaaatttattttgcaacaagtgagagcccaggagacctccttattatcctgtctctgctttgaggcaatcaagtaccctctctgaacctaggttccctcatctgtaaaacaaaggtttcagaccagatggtgtttaaggtttctccccatactggaatgaatgatttcttggtggtattagcatcatcacagacctatacttgctttctgaaactctaccacatactgaaggaatacaggaatgggattaagatgactagcatagcagtgtacagcttgaagagatgttccacatcatcactccagctccttctcttttctcagggacaaatgaggcccagagagaatacgacctgtgtaaggtcaaacagtggcagggaaagaaggagagctggggtttagcattctccctggtgaagattggaggtccaaagaaatgactcctttttaagggatgggcataaaaaagtgatcaaaacattgcaaaggagaatcaaagattgattgtcctggggctaagaaagaagataatttttaaagaatgggagtgggcaacagtgaaaaatattgcagataagtagataaggatagaagatcaaccactgactggtagta

SEQ ID NO: 47 - DNA, 1290 bp, Homo sapiens
gctaaccaggccagtgacagaaatggattcgaaataccagtgtgtgaagctgaatgatggtcacttcatgcctgtcctgggatttggcacctatgcgcctgcagaggttcctaaaagtaaagctctagaggccgtcaaattggcaatagaagccgggttccaccatattgattctgcacatgtttacaataatgaggagcaggttggactggccatccgaagcaagattgcagatggcagtgtgaagagagaagacatattctacacttcaaagctttggagcaattcccatcgaccagagttggtccgaccagccttggaaaggtcactgaaaaatcttcaattggactatgttgacctctatcttattcattttccagtgtctgtaaagccaggtgaggaagtgatcccaaaagatgaaaatggaaaaatactatttgacacagtggatctctgtgccacatgggaggccatggagaagtgtaaagatgcaggattggccaagtccatcggggtgtccaacttcaaccacaggctgctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccatcgagaagaaccatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtgtttgaattccagttgacttcagaggagatgaaagccatagatggcctaaacagaaatgtgcgatatttgacccttgatatttttgctggcccccctaattatccattttctgatgaatattaacatggagggcattgcatgaggtctgccagaaggccctgcgtgtggatggtgacacagaggatggctctatgctggtgactggacacatcgcctctggttaaatctctcctgcttggcgacttcagtaagctacagctaagcccatcggccggaaaagaaagacaataattttgtttttcattttgaaaaaattaaatgctctctcctaaagaaacttcacctaaaaaaaaaaaaaaaaaaaaaaaaaaaaaaaaaaaaaaaaaaaaaaaaaaaaaaaaaaaaaaaaaaaaaaaaaa

SEQ ID NO: 48 - DNA, 603 bp, Homo sapiens
cgtgctgctacacaagaaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattgttccataataaacttctggtgtgatactt

SEQ ID NO: 49 - DNA, 5054 bp, Homo sapiens
actcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaactgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 50 - DNA, 7109 bp, Homo sapiens
tggattatgatttttgtttatttttcctgtttatccatatattatttttcaacaatgagtattgattacttatataataattttaaggctgtacacattgcagacagcaccccactgtttgaaaaactcctcctcagtagaacatggcagaccttcatcttccttccctgaaccttttccaaccttaggcttgccattctccaccagtgctaatgtcatgtctcttgaaatctgtattgaagtcagtatttcattcttgccagtttccactgtgtgtttaaatttggagtctggtgtctagcattagctggggttggagcttccactcctctcagcattggtaagcctcctcacccaccccatcccatgtccaagatcacccagttacacacttaccatctacccagttcattcacatcatcagtcccagagctgcagagatgctctttttctacctcctacttctctggctcttagagaggcagcatgggataatggggcaagcgaatagggccttaaagtagagggacaagggttctcttccctatctgccacttattagctatgtgacctcgtgtaagtctcttttctttttgagacagggtctccctctgtcacctaggctggagtacagtggtatgatcatagctcactgcagcctcgaactcctgggctcaagctatccttccaccttagccttctgagcagcagggactacaggcacatgccaccatgtccggctgatttatttatttttatttgggaagatgggggtctcactatgtcgcccaggctggtcatgaactcctggtctcaagcaaccctccaaccttggactcccaaagtgctgggattacaggtgtgagccctggccttgcctcaatttcctcatctgtaaaacggggttagtgaaactcacatcctatcagtggttttgaggatgggccgactcttgtattgcctgctctagtacaatcagcagctaaggcggctcactttccggccgtgctacaataggtaagaactaggatgctttagacgtgtgactgggcagtgggagcccctcacatgatcccgagatgccagacagtgtctctccgcacagggcgtgtgctggtccagaggcccgtttttccagtcgccccacaccccgggtccgcgatcacgctccccccacccatagccgagcctgacgcggcggtggctcatgcgcctttccgtcccagcctttagccacggaccacacgtcccatctcaggcgccccgcccctcccccgccccccgcccccggcgcgcctccccaggctgccggctccggtgtctgagcggccgcgcccgcgagccgtgagcgatgattggctgcgccacggcggcgggcggtccgtgggcgcacacaccctccccgcgcagccaatgggcgtgcgcacgtcactgatccggaggcccgcgggccggcagcccctcaataagccacattgttgcatgaaactccggcgcaggagtcccgggctgccgctggcaacatcgtgtcacccagctaagaaaatccgcgggcccgagccacgcgcctgtgaatcggagaggtcccactgcccgagtggagccgggctgagattcttctcaagttgagcctcagtgatcctgtggccgaagttagcgccttgacgtgggacaaccggacacgtcgccaggagagaactgaggcgccttctagcagttgtgacgccaaaatcacgtctccggagacccgcgccctccgccagccgggcgcaccctcgccggtagccttctttgtgcgccgtccggactcccagctcccggcccggcagccgagccccagcacaaagcagtcggaccgcgccgcccgcctcccctctcgcgtctccgcctcggtttcccaactctgcgccgtcgggccgcggcaggatgattgcctcgcatctgcttgcctacttcttcacggagctcaaccatgaccaagtgcagaaggttgaccagtatctctaccacatgcgcctctctgatgagaccctcttggagatctctaagcggttccgcaaggagatggagaaagggcttggagccaccactcaccctactgcagcagtgaagatgctgcccacctttgtgaggtccactccagatgggacagaacacggagagttcctggctctggatcttggagggaccaacttccgtgtgctttgggtgaaagtaacggacaatgggctccagaaggtggagatggagaatcagatctatgccatccctgaggacatcatgcgaggcagtggcacccagctgtttgaccacattgccgaatgcctggctaacttcatggataagctacaaatcaaagacaagaagctcccactgggttttaccttctcgttcccctgccaccagactaaactagacgagagtttcctggtctcatggaccaagggattcaagtccagtggagtggaaggcagagacgttgtggctctgatccggaaggccatccagaggagaggggactttgatatcgacattgtggctgtggtgaatgacacagttgggaccatgatgacctgtggttatgatgaccacaactgtgagattggtctcattgtgggcacgggcagcaacgcctgctacatggaagagatgcgccacatcgacatggtggaaggcgatgaggggcggatgtgtatcaatatggagtggggggccttcggggacgatggctcgctcaacgacattcgcactgagtttgaccaggagattgacatgggctcactgaacccgggaaagcaactgtttgagaagatgatcagtgggatgtacatgggggagctggtgaggcttatcctggtgaagatggccaaggaggagctgctctttggggggaagctcagcccagagcttctcaacaccggtcgctttgagaccaaagacatctcagacattgaaggggagaaggatggcatccggaaggcccgtgaggtcctgatgcggttgggcctggacccgactcaggaggactgcgtggccactcaccggatctgccagatcgtgtccacacgctccgccagcctgtgcgcagccaccctggccgccgtgctgcagcgcatcaaggagaacaaaggcgaggagcggctgcgctctactattggggtcgacggttccgtctacaagaaacacccccattttgccaagcgtctacataagaccgtgcggcggctggtgcccggctgcgatgtccgcttcctccgctccgaggatggcagtggcaaaggtgcagccatggtgacagcagtggcttaccggctggccgatcaacaccgtgcccgccagaagacattagagcatctgcagctgagccatgaccagctgctggaggtcaagaggaggatgaaggtagaaatggagcgaggtctgagcaaggagactcatgccagtgcccccgtcaagatgctgcccacctacgtgtgtgctaccccggacggcacagagaaaggggacttcttggccttggaccttggaggaacaaatttccgggtcctgctggtccgtgttcggaatgggaagtggggtggagtggagatgcacaacaagatctacgccatcccgcaggaggtcatgcacggcaccggggacgagctctttgaccacattgtccagtgcatcgcggacttcctcgagtacatgggcatgaagggcgtgtccctgcctctgggttttaccttctccttcccctgccagcagaacagcctggacgagagcatcctcctcaagtggacaaaaggcttcaaggcatctggctgcgagggcgaggacgtggtgaccctgctgaaggaagcgatccaccggcgagaggagtttgacctggatgtggttgctgtggtgaacgacacagtcggaactatgatgacctgtggctttgaagaccctcactgtgaagttggcctcattgttggcacgggcagcaatgcctgctacatggaggagatgcgcaacgtggaactggtggaaggagaagaggggcggatgtgtgtgaacatggaatggggggccttcggggacaatggatgcctagatgacttccgcacagaatttgatgtggctgtggatgagctttcactcaaccccggcaagcagaggttcgagaaaatgatcagtggaatgtacctgggtgagattgtccgtaacattctcatcgatttcaccaagcgtggactactcttccgaggccgcatctcagagcggctcaagacaaggggcatctttgaaaccaagttcttgtctcagattgagagtgactgcctggccctgctgcaagtccgagccatcctgcaacacttagggcttgagagcacctgtgacgacagcatcattgttaaggaggtgtgcactgtggtggcccggcgggcagcccagctctgtggcgcaggcatggccgctgtggtggacaggatacgagaaaaccgtgggctggacgctctcaaagtgacagtgggtgtggatgggaccctctacaagctacatcctcactttgccaaagtcatgcatgagacagtgaaggacctggctccgaaatgtgatgtgtctttcctgcagtcagaggatggcagcgggaagggggcggcgctcatcactgctgtggcctgccgcatccgtgaggctggacagcgatagaacccctgaaatcggaagggacttcctctttctctccttcttccctgttttaaattataagatgtcatccccttgtgtcagagacagaccccttggcttttgcttggcagagaggaccccactggactgggttttgtctctgcatctcattgtagagcttggtggctgagcttggccctattaagataaatagagttccaaataaggatttgttcacatgcatcataaccattcccattggttctcctaaaacatgaaaattatctcccttagtaatcccccttgccaaattccatgtccctgtataattctacaggatggggacactaatgaagatacggttgcttcaccttggagcctgaacatgacatttctaagtggggtgcatcccccagcactgatgttgttactgattctcctgtcagagatctgggaggtctccactgaggatgtgagcctgattatcctataggcagacgtggggagggtggaggggtgacagtggaggaaaatccatggatatccacgcagcagcccctctttaacctcatctacaagcatttgccctgtggattccagcatttgccattcctggaatcaaggaatcctgagtctgggcaatgaaaccaaagccaggagttgacgcatcctgcagttgggccagctgtcgcatctcagcggggcgcacatgttatccacaagcaatggacctttggggaagggggagtttttagtttgttttacaaatttttcctgcaaaagtggaatcactgtattttcattttaatttatatttgaaattttatttagttcttgagtagatctgcttcttcatcttgacatgtaatgaatggtcagttgtacgtaatgtatttatatgttaatttgttatgtatatagatgtgcaagtcttgtcagaattggcctcagtgtagttaaagggcagaaggggaagatactgactagtcatagaaatacctcattcgcctgtgggaagagaagggaagcctcttcagggtgagtgaatggcaaagcggttgcttctggctcctccttcccctgtggtcttggaagtgtgtggaaggcagggacagagatggaggccgagccaatagactgaagagaccacagcaattggctcctccatctagagattttcttggcagtattccatgggatgttaagcaaaggaaaccaaaggaatcgtttcaaatggactcatggcttagaaatctttattcttagggcagtcagtagtattctaaagctttctgacaagataaaggaagtcaccaaaatttctttttttaaattgtatctaatcctcaacaacaaaccaaaacagaacaattaaacagccaaataaaacctcagggacaacatttttggtgtatttgagccctcccagcaagtttcaccttgggtttgtattttaaatgttttacaagaattgtccatgtgcttccctaggctgagctggcattggtctgctgacctgtttttgtgtttttcttttttttatacacaacatttatttcaaactattgggagggatgagagtggcttaaaaacttccatccctacttttcaagagtgcagttgattctgaatctgaaagcccgcctctgtcctaaaatacaaacaagcacagacattaaacctggatactatatgataaagagggatgtaactattgaattggatacaaggatcagaatggaaagaaactcacgatgaaattgaacctggtttttgtatatttatcaaacttgtgctgagaatagtgtctgattatacgacttttaagcaaagttgggtgtaattaggtgaaaacagcccaggtcctcccgggagcacagaggggctaggggctggtccttctcgtttgctctagtcttgctttgctgtctggtgtagctcctctgctgctcccatctgcactaattgacccaaaacgtgggtatttcctgctacacaaaagccaaaaggtttcatgtagattttagttcactaaagggtgcccacaaaatagagattaattttaacttaaattttaagcttgaagattaggtactatctgtgaagttacacttttttttttttttttaaaggtagagatgtgtgtgtgtgtaggtattaaagatgtgttgttggtttccaaaaaggaacactggaaaataaattttgaatgtttatgttctcagaatcaggttgacagtcccttgctgacatggctttgctttgtgtaaatacagtggatctcaatcttcggggtgtgatgaatagcgaatcatctcaaatccttgagcactcagtctagtgaagatgttgtcattatgtacaatacataactagtttaattaactatgtgatgttaactattattaataaattttaacattttccaaaataaaaaaaaaaaaaaaaaa

SEQ ID NO: 51 - DNA, 670 bp, Homo sapiens
  misc_feature (8)..(8): n is a, c, g, or t
  misc_feature (18)..(18): n is a, c, g, or t
  misc_feature (75)..(75): n is a, c, g, or t
  misc_feature (205)..(205): n is a, c, g, or t
  misc_feature (319)..(319): n is a, c, g, or t
ctacatantaggtaagangcataatggcatgaaaaaaacatagcataaactaaaaaattatttgtctttgtcagngcagtaacaattattccattggattaatagattatatctgaaaaagaaagagaaccactactttttctaaaccttcggtggaattggattccttgttcaggcaatcttttgagtttcctttgttggaagntttagagcatgagaaggtctattttctgccttaaataaataaatattttatggttagcctacaggtattgccaaaagttaaagaatattaccaaatataccaataaaataattntgaaatactcgtttatgtctatataaagaaaataaaaacagggtttagctcaagaatgattctcatatgtctaaacactacccaacataagcattaaagtatattaaagagtatcggtttctgcagtcagaagttggtttaaatcctagctccttcctttactaactttataaatctgcctaagttataggaccttcttgtgtctctatttctgcataagaaatgggtactaggcttaatacctgggtgatgaaataatctgtacaataaaccccgatgacataagtttacctgtgtaacaaaccagcacatgtacccctgaactgaaaataagttaaaaaaaaaaaaaaa

SEQ ID NO: 52 - DNA, 1201 bp, Homo sapiens
tttggtgacactatagaacaagtttgtacaaaaaagcaggctggtaccggtccggaattcccgggataagggagaggcctccttctgaggggcggcttgataccggtggaggtaagctggcgcgaggctctgtgaggagtcaaggttctcgggacaggctaaccaggaggacaggagccccaagaggccccagagcagcactgacgaagacctgcctgtgggtctccatcgcccagctcctgcccacgctcctgactgctgccctgaccagagtcatcatgtctctcgagcagaggagtccgcactgcaagcctgatgaagaccttgaagcccaaggagaggacttgggcctgatgggtgcacaggaacccacaggcgaggaggaggagactacctcctcctctgacagccaggaggaggaggtgtctgctgctgggtcatcaagtcctccccagagtcctcagggaggcgcttcctcctccatttccgtctactacactttatggagccaattcgatgagggctccagcagtyaagaagaggaagagccaagctcctcggtcgacccagctcagctggagttcatgttccaagaagcactgaaattgaaggtggctgagttggttcatttcctgctccacaaatatcgagtyaaggagccggtcacaaaggcagaaatgctggagagcgttatcaaaaattacaagcgctactttcctgttatcttcggcaaagcctccgagttcatgcaggtgatctttggcactgatgtkaaggaggtggaccccgccggccactcctacatccttgtyactgctcttggcctctcgtgcgawacatgctggggtgatggtcatagcatgcccaaggccgccctcctgatcattgttctgggtgtkatcctaaccaaagacaactgcgcccctgaagaggttatctgggaagcgttgagtgtkatggggggtgtatgttgggaaggagcacatgttctacggggagccaggaagctgctcacccaagattgggtgcaggaaaactacctggagtyccggmrgtgcccggcagttatcctgcgcmctacgagtycctgtkgggttcaaggcccacgctgaaaccagctatgagaagggtataaattatttkgtyatgctcattgaagagagcccgtctbcwmccaycccttwttgagaggktttggggg

SEQ ID NO: 53 - DNA, 2116 bp, Homo sapiens
acatccgcggcaacgcctccttggtgtcgtccgcttccaataacccagcttgcgtcctgcacacttgtggcttccgtgcacacattaacaactcatggttctagctcccagtcgccaagcgttgccaaggcgttgagagatcatctgggaagtcttttacccagaattgctttgattcaggccagctggtttttcctgcggtgattcggaaattcgcgaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaataaaataaaaataaattcacctagtctaaggatgctaaaccttagtactgagttacattgtcatttatatagattataacttgtctaaataagtttgcaatttgggagatatatttttaagataataatatatgtttaccttttaattaatgaaatatctgtatttaattttgacactatatctgtatataaaatattttcatacagcattacaaattgcttactttggaatacatttctcctttgataaaataaatgagctatgtattaacaaaaaaaaaaaaaaaaaaaaaaaaaaaaaaaaaaaaaaa

SEQ ID NO: 54 - DNA, 3351 bp, Homo sapiens
gcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaacttttgtcggagccccgacggcgcgggcagaccctggtgtttctacggagacgcccgtggcaaggtggactggggctactgcgactgcagacacggatcagtacgacttcgtggcggcaaaaatgagtttgaaggcacagtggaagtatatgcaagtggagtttggggcactgtctgtagcagccactgggatgattctgatgcatcagtcatttgtcaccagctgcagctgggaggaaaaggaatagcaaaacaaaccccgttttctggactgggccttattcccatttattggagcaatgtccgttgccgaggagatgaagaaaatatactgctttgtgaaaaagacatctggcagggtggggtgtgtcctcagaagatggcagctgctgtcacgtgtagcttttcccatggcccaacgttccccatcattcgccttgctggaggcagcagtgtgcatgaaggccgggtggagctctaccatgctggccagtggggaaccgtttgtgatgaccaatgggatgatgccgatgcagaagtgatctgcaggcagctgggcctcagtggcattgccaaagcatggcatcaggcatattttggggaagggtctggcccagttatgttggatgaagtacgctgcactgggaatgagctttcaattgagcagtgtccaaagagctcctggggagagcataactgtggccataaagaagatgctggagtgtcctgtacccctctaacagatggggtcatcagacttgcaggtgggaaaggcagccatgagggtcgcttggaggtatattacagaggccagtggggaactgtctgtgatgatggctggactgagctgaatacatacgtggtttgtcgacagttgggatttaaatatggtaaacaagcatctgccaaccattttgaagaaagcacagggcccatatggttggatgacgtcagctgctcaggaaaggaaaccagatttcttcagtgttccaggcgacagtggggaaggcatgactgcagccaccgcgaagatgttagcattgcctgctaccctggcggcgagggacacaggctctctctgggttttcctgtcagactgatggatggagaaaataagaaagaaggacgagtggaggtttttatcaatggccagtggggaacaatctgtgatgatggatggactgataaggatgcagctgtgatctgtcgtcagcttggctacaagggtcctgccagagcaagaaccatggcttactttggagaaggaaaaggacccatccatgtggataatgtgaagtgcacaggaaatgagaggtccttggctgactgtatcaagcaagatattggaagacacaactgccgccacagtgaagatgcaggagttatttgtgattattttggcaagaaggcctcaggtaacagtaataaagagtccctctcatctgtttgtggcttgagattactgcaccgtcggcagaagcggatcattggtgggaaaaattctttaaggggtggttggccttggcaggtttccctccggctgaagtcatcccatggagatggcaggctcctctgcggggctacgctcctgagtagctgctgggtcctcacagcagcacactgtttcaagaggtatggcaacagcactaggagctatgctgttagggttggagattatcatactctggtaccagaggagtttgaggaagaaattggagttcaacagattgtgattcatcgggagtatcgacccgaccgcagtgattatgacatagccctggttagattacaaggaccagaagagcaatgtgccagattcagcagccatgttttgccagcctgtttaccactctggagagagaggccacagaaaacagcatccaactgttacataacaggatggggtgacacaggacgagcctattcaagaacactacaacaagcagccattcccttacttcctaaaaggttttgtgaagaacgttataagggtcggtttacagggagaatgctttgtgctggaaacctccatgaacacaaacgcgtggacagctgccagggagacagcggaggaccactcatgtgtgaacggcccggagagagctgggtggtgtatggggtgacctcctgggggtatggctgtggagtcaaggattctcctggtgtttataccaaagtctcagcctttgtaccttggataaaaagtgtcaccaaactgtaattcttcatggaaacttcaaagcagcatttaaacaaatggaaaactttgaacccccactattagcactcagcagagatgacaacaaatggcaagatctgtttttgctttgtgttgtggtaaaaaattgtgtaccccctgctgcttttgagaaatttgtgaacattttcagaggcctcagtgtagtggaagtgataatccttaaatgaacattttctaccctaatttcactggagtgacttattctaagcctcatctatcccctacctatttctcaaaatcattctatgctgattttacaaaagatcatttttacatttgaactgagaaccccttttaattgaatcagtggtgtctgaaatcatattaaatacccacatttgacataaatgcggtaccctttactacactcatgagtggcatatttatgcttaggtcttttcaaaagacttgacaagaaatcttcatattctctgtagcctttgtcaagtgaggaaatcagtggttaaagaattccactataaacttttaggcctgaataggagtagtaaagcctcaaggacatctgcctgtcacaatatattctcaaagtgatctgatatttggaaacaagtatccttgttgagtaccaagtgctacagaaaccataagataaaaatactttctacctacagcgtgc

SEQ ID NO: 55 - DNA, 1933 bp, Homo sapiens
cgtcacagcccgacgcgccacccagctgtttttgtgctcacaagctctagcgaaaagccgccggtatttctccatctggctctcctctacctccaggcaggctcacccgagatccccgccccgaaccccccctgcacactcggcccagcgctgttgcccccggagcggacgtttctgcagctattctgagcacaccttgacgtcggctgagggagcgggacagggtcagcggcgaaggaggcaggccccgcgcggggatctcggaagccctgcggtgcatcatgaagttccagtacaaggaggaccatccctttgagtatcggaaaaaggaaggagaaaagatccggaagaaatatccggacagggtccccgtgattgtagagaaggctccaaaagccagggtgcctgatctggacaagaggaagtacctagtgccctctgaccttactgttggccagttctacttcttaatccggaagagaatccacctgagacctgaggacgccttattcttctttgtcaacaacaccatccctcccaccagtgctaccatgggccaactgtatgaggacaatcatgaggaagactattttctgtatgtggcctacagtgatgagagtgtctatgggaaatgagtggttggaagcccagcagatgggagcacctggacttgggggtaggggaggggtgtgtgtgcgcgacatggggaaagagggtggctcccaccgcaaggagacagaaggtgaagacatctagaaacattacaccacacacaccgtcatcacattttcacatgctcaattgatattttttgctgcttcctcggcccagggagaaagcatgtcaggacagagctgttggattggctttgatagaggaatggggatgatgtaagtttacagtattcctggggtttaattgttgtgcagtttcatagatgggtcaggaggtggacaagttggggccagagatgatggcagtccagcagcaactccctgtgctcccttctctttgggcagagattctatttttgacatttgcacaagacaggtagggaaaggggacttgtggtagtggaccatacctggggaccaaaagagacccactgtaattgatgcattgtggcccctgatcttccctgtctcacacttcttttctcccatcccggttgcaatctcactcagacatcacagtaccaccccaggggtggcagtagacaacaacccagaaatttagacagggatctcttacctttggaaaataggggttaggcatgaaggtggttgtgattaagaagatggttttgttattaaatagcattaaactggaattgacaagagtgttgagcatccctgtctaacctgctctttctctttggtgccccttatctcaccccttccttggaatttaataagtctcaggcatttccaattgtagactaaaaccactcttagcatctcctctagtattttccatgtatcaggacagaggtgtcttatgtagggagggggcaagtatgaagtaaggtaattatatactactctcattcaggattcttgctcccatgctgctgtcccttcaggctcacatgcacaggaatgctacatgatggccagctgcttccctccttggttatcatccactgcagctgctagttagaaaggtttggagggatgacttttagtaaatcatggggattttattgatttattttcacttttgggattttgtggggtgggagtggggagcaggaattgcactcagacatgacatttcaattcatctctgctaatgaaaagggttctttctcttgggggaaatgtgtgtgtcagttctgtcagctgcaagttcttgtataatgaagtcaatgccatcaggccaaggaaataaaataattgcttaccttaaaaaaaaaaaaaaaaaaaaaaaaaaa

SEQ ID NO: 56 - DNA, 672 bp, Homo sapiens
caaccatgaagctcctttttcctatctttgccagcctcatgctacagtaccaggtgaacacagaatttattggcttgagacgctgtttaatgggtttggggagatgcagggatcactgcaatgtggatgaaaaagagatacagaaatgcaagatgaaaaaatgttgtgttggaccaaaagtggttaaattgattaaaaactacctgcaatatggaacaccaaatgtacttaatgaagacgtccaagaaatgctaaaacctgccaagaattctagtgctgtgatacaaagaaaacatattttatctgttctcccccaaatcaaaagcactagcttttttgctaataccaactttgtcatcattccaaatgccacccctatgaactctgccaccatcagcactatgaccccaggacagatcacatacactgctacttctaccaagagtaacaccaaagaaagcagagattctgccactgcctcgccaccaccagcaccacctccaccaaacatactgccaacaccatcactggagctagaggaagcagaagagcagtaatgtggatctttcccttaaaactccaagttcctctctatttttgctatctataaaatgacatagaactgtttcctctgtcatcagtcattcaataaacactgtttgagcacctaca

SEQ ID NO: 57 - DNA, 8864 bp, Homo sapiens
tagaagcattttctttggcagcaagaagataattttatagaagccatgcctgttcttggggttgcctcaaaactgaggcagccagctgttgggtcaaagcctgtgcatactgctcttccgataccaaatcttggcactactgggtcacagcactgttcttcaagacctttggaacttgctgaaacagagagctccatgctttcttgtcagcttgcgttaaaatcaacctgtgaatttggagagaagaaacccctccaaggaaaagccaaggagaaagaagacagcaagatttacactgactgggccaaccactacctagcaaaatcaggccacaagcggctgatcaaggacttgcaacaagacattgcagatggagtactcctagcagaaatcatccagattattgcaaatgaaaaagttgaagatatcaatggatgtcctagaagtcagtctcagatgattgaaaatgttgatgtctgccttagttttctagcagccagaggggtaaatgttcaaggtctatctgctgaagaaataagaaatggaaacttaaaagccattctagggctgtttttcagtttatctcgctacaagcagcaacaacaccatcaacaacagtactatcagtccttggtggaacttcagcagcgagttactcacgcttcccctccatcggaagccagccaggccaaaacccagcaagatatgcagtccagtctggcagccagatatgcaactcagtctaatcacagtggaattgcaaccagtcaaaaaaagcctactaggcttccagggccctctagggtgcctgctgcaggaagcagcagcaaggtccagggagcctctaatttaaataggagaagtcagagctttaacagcattgacaaaaacaagcctccaaattatgcaaatggaaacgaaaaagattcctccaaaggacctcaatcgtcttcaggtgtaaatggtaacgtgcagcctcccagtactgctgggcagcctcctgcctctgccatcccttctccaagtgccagcaagccctggcgcagcaagtccatgaatgtcaaacacagtgccacctccaccatgttgactgtaaagcagtcaagtacagccacctcccccacaccatcttcagacagactgaagccacctgtctcagaaggggtcaaaactgctccctcaggacagaaatccatgcttgagaaattcaagctagtcaatgcccggactgctttacgccccccgcagcctcccagttcaggacctagtgatggtgggaaggatgatgatgccttttctgaatctggtgaaatggaaggttttaacagtggtctgaatagtggtggctcaacaaatagcagtcccaaagtgtcacctaagttggcccctccaaaagctggaagcaaaaatctcagcaataaaaagtctttgctacagccaaaggaaaaagaagaaaagaacagggacaaaaataaagtttgcactgaaaaaccagtcaaagaagagaaggatcaggtgacagagatggctccaaaaaagacctccaaaattgcaagcttgatccctaagggcagcaagacaacagcagctaagaaggaaagcttaattccgtcttccagtggtattccaaaaccaggctctaaagttccaacagtaaagcaaaccatttcacctggcagcacagcaagcaaagagtctgagaaattcaggactaccaaggggagcccttcccagtccttatctaagcctataaccatggagaaagcaagtgcttctagttgtcctgcccctttggaaggaagggaagctggccaagcttctccttctggttcctgtaccatgacagtggcacaaagcagtgggcagagcacaggaaatggtgctgtccaactccctcaacagcagcaacatagccacccgaataccgcgacagtggcaccattcatttacagggcacattcagaaaatgaaggtaccgctttaccatcggctgactcctgtaccagtcctacaaagatggacttatcatatagtaagactgctaagcagtgcctggaggagatatctggtgaaggccctgaaacaagaagaatgagaacagttaaaaacatagcagacttgaggcagaatttagaagagactatgtccagtcttcgtgggactcagataagccacagcaccctggagacaacatttgacagcactgtgacaacagaagttaatggaaggaccatacccaacttgacaagtcgacccacccccatgacctggaggttgggccaggcatgtccgcgacttcaggcgggagatgctccctccctgggtgctggctatcctcgcagtggtaccagtcgattcatccacacagacccctcgaggttcatgtataccacgcctctccgtcgagctgctgtctctaggctgggaaacatgtcacagattgacatgagtgagaaagcaagcagtgacctggacatgtcttctgaggtcgatgtgggtggatatatgagtgatggtgatatccttgggaaaagtctcaggactgatgacatcaacagtgggtacatgacagatggaggacttaacctatatactagaagtctgaaccgaataccagacacagcaacttcccgggacatcatccagagaggggttcacgatgtgacagtggatgcagacagctgggatgacagcagttcagtgagcagtggtctcagtgacacccttgataacatcagcactgatgacctgaacaccacatcctctgtcagctcttactccaacatcaccgtcccctctaggaagaatactcagctgaggacagattcagagaaacgctccaccacagacgagacctgggatagtcctgaggaactgaaaaaaccagaagaagattttgacagccatggggatgctggtggcaagtggaagactgtgtcctctggacttcctgaagaccccgagaaggcagggcagaaagcttccctgtctgtttcacagacaggttcctggagaagaggcatgtctgcccaaggaggggcgccatctaggcagaaagctggaacaagtgcactcaaaacacccgggaaaaccgatgatgccaaagcttctgagaaaggaaaagctcccctaaaaggatcatctctacaaagatctccttcagatgcaggaaaaagcagtggagatgaagggaaaaagcccccctcaggcattggaagatcgactgccaccagctcctttggctttaagaaaccaagtggagtagggtcatctgccatgatcaccagcagtggagcaaccataacaagtggctctgcaacactgggtaaaattccaaaatctgctgccattggcgggaagtcaaatgcagggagaaaaaccagtttggacggttcacagaatcaggatgatgttgtgctgcatgttagctcaaagactaccctacaatatcgcagcttgccccgcccttcaaaatccagcaccagtggcattcctggccgaggaggccacagatccagtaccagcagtattgattccaacgtcagcagcaagtctgctggggccaccacctcgaaactgagagaaccaactaaaattgggtcagggcgctcgagtcctgtcaccgtcaaccaaacagacaaggaaaaggaaaaagtagcagtctcagattcagaaagtgtttctttgtcaggttcccccaaatccagccccacctctgccagcgcctgtggtgcacaaggtctcaggcagccaggatccaagtatccagatattgcctcacccacatttcgaaggttgtttggtgccaaggcaggtggcaaatctgcctctgcacctaatactgagggtgtgaaatcttcctcagtaatgcccagccctagtaccacattagcgcggcaaggcagtctggagtcaccgtcgtccggtacgggcagcatgggcagtgctggtgggctaagcggcagcagcagccctctcttcaataaaccctcagacttaactacagatgttataagcttaagtcactcgttggcctccagcccagcatcggttcactctttcacatcaggtggtctcgtgtgggctgccaatatgagcagttcctctgcaggcagcaaggatactccgagctaccagtccatgactagcctccacacgagctctgagtccattgacctccccctcagccatcatggctccttgtctggactgaccacaggcactcacgaggtccagagcctgctcatgagaacgggtagtgtgagatctactctctcagaaagcatgcagcttgacagaaatacactacccaaaaagggactaagatataccccatcatctcggcaggccaaccaagaagagggcaaagagtggttgcgttctcattctactggagggcttcaggacactggcaaccagtcacctctggtttccccttctgccatgtcatcttctgcagctggaaaataccacttttctaacttggtgagcccaacaaatttgtctcartttaaccttcccgggcccagcatgatgcgctcaaacagcatcccagcccaagactcttccttcgatctctatgatgactcccagctttgtgggagtgccacttctctggaggaaagacctcgtgccatcagtcattcgggctcattcagagacagcatggaagaagttcatggctcttcattatcactggtgtccagcacttcttctctttactctacagctgaagaaaaggctcattcagagcaaatccataaactgcggagagagctggttgcatcacaagaaaaagttgctaccctcacatctcagctttcagcaaatgctcaccttgtagcagcttttgaaaagagcttagggaatatgactggccgattgcaaagtctaactatgacagcggaacaaaaggaatctgaacttatagaactaagagaaaccattgaaatgctgaaggctcagaattctgctgcccaggcggctattcagggagcactgaatggtccagaccatcctcccaaagatcttcgcatcagaagacagcattcctctgaaagtgtttctagtatcaacagtgccacaagccattccagtattggcagtggtaatgatgccgactccaagaagaagaaaaagaaaaactgggtgaactctagaggaagtgagctgagaagttctttcaaacaagcctttgggaagaaaaagtccaccaagcctccttcatcacattctgacattgaagagcttactgattcatcccttccggcatcccccaagttaccccataatgctggtgactgtggctcagcatccatgaagccctcacaatctgcttcagcgtcaccccttgtctggccaccaaagaaacgacaaaatggccctgtgatctacaagcatagatctcggatctgtgaatgcacagaagctgaggcagagataattctgcagctgaagagcgagctcagagaaaaggaattaaaattaacggatattcggctggaggccctcagctctgctcatcatcttgatcagatccgggaagccatgaaccggatgcagaatgaaattgaaatactgaaagctgaaaatgaccggttgaaggcagaaactggtaacacagctaagcctactcggccaccgtcagaatcctcaagcagcacctcctcttcatcttccaggcagtcattaggactttctctaaacaatttgaacatcacagaggctgttagctcagatattttgctagatgatgctggtgatgcaactggacataaagatggccgcagtgtgaaaattatagtctccataagcaagggctatggtcgagcaaaggaccaaaaatctcaggcatatttgataggatccattggtgttagtggaaaaaccaagtgggatgtcttagatggtgtaataagacgtctctttaaggaatatgtattccgaattgatacatccactagccttggtctgagctctgactgcattgctagctactgtataggagacttaattagatcccataacctagaagtgcctgaattgctgccttgtggataccttgttggagataataacatcatcactgtgaacctcaaaggggtagaagaaaatagtttggacagttttgtttttgatacgctgattcctaaaccaattacccaaaggtactttaacttgttgatggagcatcacagaattatactctcaggaccgagtggtactggaaagacctatttggcaaacaaacttgctgaatatgtaataaccaaatctggaaggaaaaaaacagaggatgcaattgccacttttaatgtggaccacaagtcaagtaaggaattgcaacaatatctagctaacctggctgaacagtgcagtgctgataataatggagtggagctcccagttgtaataattcttgataatcttcatcatgtgggctctctgagtgatatcttcaatggttttctcaattgtaaatacaacaaatgtccatatattattggaacaatgaatcagggagtttcttcatcaccaaatctagagctgcatcacaatttcaggtgggtattatgtgcaaatcatacagaaccagtgaaaggctttttaggcagatatcttcgaagaaaactcatagagatagaaattgaaaggaacattcgcaataatgacctagtcaaaattatagattggattccgaagacgtggcatcatctcaacagttttttggaaacacacagttcttctgacgttaccattggtccccgactattccttccttgccccatggatgtagaaggttctagagtatggttcatggatctctggaactattctttagtaccttatattctggaggcagtgagagagggtcttcagatgtatgggaaacgcacaccatgggaagatccttcaaagtgggtgcttgacacatatccatggagctcagcaactctgcctcaggagagcccagccttacttcagctgcgaccagaagatgttgggtatgaaagctgcacatccactaaggaagccacaacctcaaagcacattccacaaactgacacagaaggagatcccctgatgaatatgctaatgaaactccaagaagcagccaattactcgagcacacaaagctgcgacagcgaaagcaccagccaccatgaagacattttggattcatctcttgaatctaccctctagagggtgaaaaaagttaagggaaaagactttgcttttaaaaaaatgtttcaaaagaaaggtattttcactaaaccactgccagtataaaagcaccctgtcaagggccctgacccagagttgtggtctccaaggaggcagcagaactaagtctgaaccgccaagatgctaaattgcaatggaagcttaactttagtttatttctaagcattttttatatctgtggagtaatagaaagctccattactcaactggaaaggaccctaatgacagggcaactgaacagattgcacatgggatagccaaactggactttctttgtttcctctttaaaagtttacaatgcagaccattttttgtcccttccttttgtttcctctgaggggctgttcgccccaggcagggtccatctttctgatctgtccaacctcctttgtgccacacggtgctggtcacagggcttcagtagtgtttgtgttgtgcgctcaccccattccagaacaaatccaagaggccagtcctccataagcacaaatggaattgtgcaaccaccagaaaaacactactgtggcaaactggagaagtgccaatttaattctaactgccacgttctcatgatgtgctccaccaactttttagtatatgagtcactggttttataaggttgtttttaccacagtggtctttttaaaccacctgcccactcccttaacaagagttttataccaattattagtcaacactgataaaaggcttttttagggctttatttgtttgagccttttcagtgaaagaaggaacatttcctatggtgctgtctcactgccttaaaacagatttctatgacagtttaacagttggtttaaatcctaaaccattggtaatttccactgtcttttcatttacaaccaagcaacaccagttaacatagtagcctcatctctatatatctttctcttttttttttttttgaagaaatggataggagaaagatcagtatttttagccttgtgaatagatcgctttgcctatcctccaaaatattaaaataacccagaaatgctctttgaccgtcacttaaaacctaagacatgtggcgaaattccatccagttctaagtgaaagagtttcagaaggcaggagattttgaattattatccagcagggctggaagcactagatgcagcatgagcacaactattcggctttccttccctattgtttttgtttttttaatgagttttgacgcatgttgttttgattgctattgttgtacatgagaaattcagcattaaagaacactgaagcggtaaggtcactgtggaagaggaagcgtttatactgtaaaagaaggttagatttgcacagtctactgggtaggtattgtaaataataatttttaaaacttgcacaaatcaaaacaaacacaaacaaaattgtattttatcctgttggtgttaagaggtgtttcacttgctgagatttcctgtacattgcaaacaaatacagaatgcaaaccctcaaagctgtattatctggtgtgtttgtcctgtatttacagttgtttttgactatgcaggagctatcagtgctagagtgagcatgcttcaaaactgtacatgaagccaatatatttttggataagtaaaaaaaaaaaaaaaaaa

SEQ ID NO: 58 - DNA, 422 bp, Homo sapiens
cacaattcagaagaactttaatgcatataccatcattgccactataatagagatagaagatacattaagaaaattcagtttgtatcaataaaacagatcaacacagaacaaggaaacaccatagatatttgtaaatgagatcttctcttttgctactgtgtatatatattcctttatatttatacaaactcacaacacatgacatttcatatttcatatgccactgagaagaggtgtcagtatacagaacataggaagaagaaaaaagcatgagaacatctgcttagttagaatctgatgaggagagacgtgagagctattgttcctctctctgctcaggcctatcgagaggcaactgcagtttttgctaattgttcctcctgaggaattctgctcatactgctatggtacatctcctaggt

SEQ ID NO: 59 - DNA, 281 bp, Homo sapiens
ttttttttttttttccccacttctcaatatgctttattcaacagaacaaaagaaggacaacgcgagccgagaaagcagtgcaggaatgcagactgcatcagaaggtaccccacttgccattcagggacactgcaagagaagatcaggccaactgacttgtccgatgagcactcctgagtgtagctataatggcgcaggatggttagcaattaaagagaggactccccatctgcagctggacctagactgagtttcagttcctatggggatataggtcattt

SEQ ID NO: 60 - DNA, 791 bp, Homo sapiens
actcgtgtctcgctaccagctccccgctgccctgcgctcggcgggctggcatccggcccgggggaaagcggaccagcccttctgcaggtctgcggggccaagtgtcccggcggcgcacctcgtggcgagaatcgggagaaggaggagactacaaggataggcccaggagtaatggagtccaaagagaaactagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggggagggggtgagacagctgatggaaaagctgagggaaaagcagttgagtcatagtctgcgggcagtcagcactgacccccctcaccatgaccatcatgatgagttttgccttatgccctgaatcctgatggtttccctaaagttattacggaaacagacccctgctttcgaatttacatgttcatgatgtgcccttgttgtaaacctttacctgtcacttgtttacgtgggtctcctattaccagcttctaattgaatattgtgtttttgaaccagtctgtaagatttttgttagcagaagaattttacctattgcatggaaagatgctcattatagtgaagttaataaagcacctttaaaaa

SEQ ID NO: 61 - DNA, 291 bp, Homo sapiens
acatatatattttagtgctgatgcttaaagatcctgttgactgaaataagttgcaaggaatattagttcagggaaatatcaaagtgtaaaaatatatgggatagtgagaaagaaaaagccatccaacaccagcacattagaaattactcaatcacttctgtcatgtgaaaaagggatcagcaccccacccagagcaaactcaaactctgagtctattaccagttaagtcaagacttgggcttctatttttgcaaagtaatcaggtaactgaggtcaggctgtggaaattcc

SEQ ID NO: 62 - DNA, 678 bp, Homo sapiens
cccagtggatggctttgcctccagcggtggaccagtgtgtacctgacatgtatcagacttctgagctcttcaagctgcctcaaagaatgaatctttttagtctagaaaatgtgtttatttgataaatatactattgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttcccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattggtgaataaatatgattttagaatttcacagtaaaaaaaaaaaaaaa

SEQ ID NO: 63 - DNA, 2580 bp, Homo sapiens
cccggagctaaggcgccgaacccgcggcgcgtggggacgatgtggttctttgcccgggacccggtccgggactttccgttcgagctcatcccggagcccccagaggcggcctgcccgggccctgggccctgcaccgcggccgcaagaagggccacaggcagccccgtgtccatcttcgtctatgatgtgaagcctggcgcggaagagcagacccaggtggccaaagctgccttcaagcgcttcaaaactctacggcaccccaacatcctggcttacatcgatggactggagacagaaaaatgcctccacgtcgtgacagaggctgtgaccccgttgggaatatacctcaaggcgagagtggaggctggtggcctgaaggagctggagatctcctgggggctacaccagatcgtgaaagccctcagcttcctggtcaacgactgcagcctcatccacaacaatgtctgcatggccgccgtgttcgtggaccgagctggcgagtggaagcttgggggcctggactacatgtattcggcccaggcaaccggtgggggacctccccgcaaggggatccccgagcttgagcagtatgaccccccggagttggctgacagcagtggcagagtggtcagagagaagtggtcagcagacatgtggcgcttgggctgcctcatttgggaagtcttcaatgggcccctacctcgggcagcagccctacgcaaccctgggaagatccccaaaacgctggtgccccattactgtgagctggtgggagcaaaccccaaggtgcgtcccaacccagcccgcttcctgcagaactgccgggcacctggtggcttcatgagcaaccgctttgtagaaaccaacctcttcctggaggagattcagatcaaagagccagccgagaagcaaaaattcttccaggagctgagcaagagcctggacgcattccctgaggatttctgtcggcacaaggtgctgccccagctgctgaccgccttcgagttcggcaatgctggggccgttgtcctcacgcccctcttcaaggtgggcaagttcctgagcgctgaggagtatcagcagaagatcatccctgtggtggtcaagatgttctcatccactgaccgggccatgcgcatccgccttctgcagcagatggagcagttcatccagtaccttgacgagccaacagtcaacacccagatcttcccccacgtcgtacatggcttcctggacaccaaccctgccatccgggagcagacggtcaagtccatgctgctcctggccccaaagctgaacgaggccaacctcaatgtggagctgatgaagcactttgcacggctacaggccaaggatgaacagggccccatccgctgcaacaccacagtctgcctgggcaaaatcggctcctacctcagtgctagcaccagacacagggtccttacctctgccttcagccgagccactagggacccgtttgcaccgtcccgggttgcgggtgtcctgggctttgctgccacccacaacctctactcaatgaacgactgtgcccagaagatcctgcctgtgctctgcggtctcactgtagatcctgagaaatccgtgcgagaccaggccttcaaggccattcggagcttcctgtccaaattggagtctgtgtcggaggacccgacccagctggaggaagtggagaaggatgtccatgcagcctccagccctggcatgggaggagccgcagctagctgggcaggctgggccgtgaccggggtctctcactcacctcaagctgatccgttcgcacccaaccactgcccaacagaaaccaacattccccaaagacccacgctgaaggagttcctgccccagccccccacccctgttcctgccacccctacaacctcaggccactgggagacgcaggaggaggacaaggacacagcagaggacagcagcactgctgacagatgggacgacgaagactggggcagcctggagcaggaggccgagtctgtgctggcccagcaggacgactggagcaccgggggccaagtgagccgtgctagtcagagtccgactggagcagctgggaagctgagggctcctgggaacagggctggcaggagccaagctcccaggagccacctcctgacggtacacggctggccagcgagtataactggggtggcccagagtccagcgacaagggcgaccccttcgctaccctgtctgcacgtcccagcacccagccgaggccagactcttggggtgaggacaactgggagggcctcgagactgacagtcgacaggtcaaggctgagctggcccggaagaagcgcgaggagcggcggcgggagatggaggccaaacgcgccgagaggaaggtggccaagggccccatgaagctgggagcccggaagctggactgaaccgtggcggtggcccttcccggctgcggagagcccgccccacagatgtatttattgtacaaaccatgtgagcccggccggcccagccaggccatctcacgtgtacataatcagagccacaataaattctatttcacaaaaaaaaaaaaaaaaa

SEQ ID NO: 64 - DNA, 2390 bp, Homo sapiens
attgcaaattatggcttgctctaggatagaagcataggtgttgcatctgaaactcattctggctaaacacaatcccttctgattcttaggtccagtcaaaaggatcagttctatcaggagattacaacatgcctctgagaaatgattacttagtttagaagacagcattgcaattaaaaattcatgactgtagaattaaaaaaaaaaaaagaacccactctttccttccaggcttatgtcagacttgcaatgaagttagaatgaacaggaggagtctgcagcttttcagtgcctgggataactatagtttaaagatcattgtgtaaaataggatttttagtcagcatgcattgttttaaaccgactaactgatagcctaaaactttatttttgcattttgccaatccttggagttttgttttgcagaattaagaaaaaaatgaatgtatgatcatctgaaaagggctttctctcaatcccacttcatggcgtgacctctgctggatcattagttctagccagagaagtagcaaaggaacatgacgtctgagacctcccttccctcatcagtggggctgactgagctgggggcttgaagccggaggtaacctttcctgtcgaatgttctctttagagaatggcaatggtctctgcgatgtcctgggtcctgtatttgtggataagtgcttgtgcaatgctactctgccatggatcccttcagcacactttccagcagcatcacctgcacagaccaggtaagtcaggagctggctccactgcagcctcctccagtcttaccactatttccttaacagatggttgaatgcaagtgacataaagtgctatagtgtgggcagcttgcctttgaattccaagacatattgttggctggatgctttgggggaaggggagtgtgccaaaatgtcttggaggtatttctattaatttctcagaaaaggtgtgtttttctaagtgtcaccccacctgcttctacacaccttgaaaagtagaagtcatctgtttttggatgctttggccaatagcagaatattctgcaaaagttggaataactttcaatacttgaggattttacctactataatcttggtctgtatgtggctaagaattttgtgggggcatagtccccaaactaactttggaagcaagttgtcaatgaaaaagaaattaaaaagtaacttactatttcttgcctggtttaatgtgccttctttcctttctcccttccttcactttctgttcttccggtatgctcagtggcatttttccctctcttttggcagtttcagggacgaagtccctcccacctgatttttgttttgttttgttttgtttttcctatattgaatttttagttccggacgcattttgctttcttcctcttaatgttcaaagtatatttctcacccttccacggcctcgctcttcattctggattttgctctccttctttgcctctccagctttctcattacagtccctcccagctcgattgtccttaccttccccggttcttggaaaaatttccttccattttctgttcagtatcagccttcgcatccttctactactcaccccgccttcaccctccaccccacctccctccctcccctcccttcctctctcgcgacggtcaagttcgggctctggggaccagttgcgcgcccaagtttctgatgctcagttctgaagtgctcccagccctccacccgcctctccaaatcccatcaatggcctcctccccccatccgtcgagcttcctcctgctgcgtagtccagcgtctacgccctcgcctttccctggctcctcagtcggcctggacaccgatactaggctcttctgtacagccctccagcaataccttccggggccccgcttgctgcctcctggggctcagcttccctgctgggggcaggcatgtcagagcgcggatgcagcccagggtcctcccgcgcgcctgcaccaggctgcagcgagcgcgcaagcctgctgggtgctggagctcgggccgccccgggagaaggggtggggctggcttgtgctaggggctgaggctgggggctgtttctgggccctgccaccctgtttcccccagccctggtctgacagggaaggcgagggggcgctggtgcccctgcaggtgggcagggaaaccgccctcttcaggacgcgcttgtatttctgcatcctgtgtcctgagcctggcgcgggaaccgccactcaaaccctcagtgcagccgagatggagggaaaacaaaagtgaatttgagattcccactttacctccaatcacttaatcacaatttgttctggcacaaatgtctttcacttgttacatggtcataaataataaacagtgcgggacatctgc

SEQ ID NO: 65 - DNA, 15731 bp, Homo sapiens
cgcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcctctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctcagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgtcccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggctaggactatgagaactgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacattccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatactgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcgaagacattactgtctggtggaacatcctcagagatctaaaaaggctgtatggcataaactactgtctaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgatgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaacgggtggtgtgtctcaggacaaaaggaggctcttctcattcagctaaattcacatttgcc

SEQ ID NO: 66 - DNA, 9909 bp, Homo sapiens
agggaaacttggaggctgcgaccagggtttggcgttgttgtcagcctcggggagagagattggacaaatattctccaagaggaggagggcgacgccaaggactttccacatcaactgctttggggtatctccacaagttggaagagggaccctttcgttttgcattgcgtgtgttgtgctcattaccagtgcagcgactgccgtcccagggtgactctgagttgtcctttatcgtgagctagcaatggctagcgaagacaatcgtgtcccttccccgccaccaacaggtgatgacgggggaggtggagggagagaagaaacccctactgaagggggtgcattgtctctgaaaccagggctccccatcaggggcatcagaatgaaatttgccgtgttgaccggtttggttgaagttggagaagtatccaatagggatattgtagaaactgtctttaacctgttggtaggaggacagtttgatctggaaatgaatttcattatccaagaaggtgagagtattaactgcatggtggacctactggaaaaatgtgacattacgtgccaagcagaagtctggagcatgtttacagccattctgaagaaaagcatacggaatcttcaagtctgcactgaagtaggccttgttgaaaaagtgcttgggaaaattgaaaaagttgacaatatgatagcagatcttttggttgacatgttgggagtgctggctagctataatttgacagttcgcgagctaaagcttttcttcagtaaacttcaaggagataaaggacgatggcctccacatgctgggaagttgctgtctgtgttaaagcatatgcctcagaagtatggtcctgatgccttttttaactttccaggaaagagtgctgcagctattgcattacctcctatagccaaatggccataccagaatggttttacatttcatacatggcttagaatggatcctgtaaataacatcaatgtagataaggataaaccatatttgtattgtttcagaaccagcaaaggtcttggctattctgctcattttgttggaggctgtttgattgtaacatcaataaagtcaaaaggaaaaggctttcaacactgtgtgaaatttgatttcaagccacaaaagtggtatatggttaccatagtacacatctataaccgatggaagaatagtgaacttcgatgttatgtgaatggtgagctggcttcctatggagagataacatggtttgtcaacactagcgatacctttgacaaatgtttcctgggctcatcagaaacagcagatgctaatagagtattctgtggtcagatgactgcagtttaccttttcagtgaagctctaaatgcagctcagatatttgctatttatcagttgggcctgggatacaagggtacatttaaattcaaagcagaaagcgaccttttccttgctgagcatcacaaacttttattgtacgatgggaaactctctagtgccattgcattcacgtacaatccacgggctacagatgcccagctttgtcttgaatcatctcctaaggacaacccttcaatttttgttcattcaccacatgcactcatgctccaggatgtaaaggcagttttaacacattccatccaaagtgcaatgcattcaattggaggagtacaagtactatttccactttttgcacagttggattacaggcaatatttgtctgatgagattgatttgactatatgttcaaccttgctggcctttatcatggaattgttgaagaactcaattgctatgcaggaacagatgcttgcctgtaagggcttcttggtaataggatatagccttgaaaagtcttccaaatctcatgttagcagagcagtacttgaactttgccttgcattttcaaaatatctgagtaatctgcagaatgggatgcccctgctcaagcaattgtgtgatcacgttcttcttaatcctgccatatggattcataccccagccaaggttcaactgatgctctatacttatctgtccacggaattcattggtacagtcaacatatataacaccattcggagagttggaacagtgcttctcatcatgcacacgctgaagtactactactgggcagtgaatcctcaggatcgaagtggtatcaccccaaaaggattagatggaccgcgacctaatcaaaaagaaatgctttctctacgagcattcttgttgatgttcattaagcaattagtgatgaaggattctggagtaaaggaagatgaattacaggccattcttaattacctactgactatgcatgaggatgacaatctaatggatgtcctacagctgcttgttgcattaatgtcagaacaccctaactctatgattcctgcttttgaccaaaggaatgggttacgtgttatctacaaacttctggcatcgaaaagtgaaggaatcagggtacaagctcttaaggcaatgggttattttttaaaacatcggcccccaaagaggaaagcagaagtcatgcttggacatggattgttttcattgctagctgaaaggctcatgcttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactttctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttccagctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatgaataccaaacccgctactgatggtgacagctgtacatcaactctgcccctaggatgagcagaagtacctggagcataattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaaaaaaaaaaaaaa

SEQ ID NO: 67 - DNA, 6310 bp, Homo sapiens
gatgggggccccgtttgtctgggccttgggccttttgatgctgcagatgctgctctttgtggctggggaacagggcacacaggatatcaccgatgccagcgaaagggggctccacatgcagaagctggggtctgggtcagtgcaggctgcgctggcggagctggtggccctgccctgtctctttaccctgcagccacggccaagcgcagcccgagatgcccctcggataaagtggaccaaggtgcggactgcgtcgggccagcgacaggacttgcccatcctggtggccaaggacaatgtcgtgagggtggccaaaagctggcagggacgagtgtcactgccttcctacccccggcgccgagccaacgccacgctacttctggggccactgagggccagtgactctgggctgtaccgctgccaggtggtgaggggcatcgaggatgagcaggacctggtgcccttggaggtgacaggtgttgtgttccactaccgatcagcccgggaccgctatgcactgaccttcgctgaggcccaggaggcctgccgtctcagctcagccatcattgcagcccctcggcatctacaggctgcctttgaggatggctttgacaactgtgatgctggctggctctctgaccgcactgttcggtatcctatcacccagtcccgtcctggttgctatggcgaccgtagcagccttccaggggttcggagctatgggaggcgcaacccacaggaactctacgatgtgtattgctttgcccgggagctggggggcgaggtcttctacgtgggcccggcccgccgcctgacactggccggcgcgcgtgcacagtgccgccgccagggtgccgcgctggcctcggtgggacagctgcacctggcctggcatgagggcctggaccagtgcgacccgggctggctggccgacggcagcgtgcgctacccgatccagacgccgcgccggcgctgcgggggcccagccccgggcgtgcgcaccgtctaccgcttcgctaaccggaccggcttcccctcacccgccgagcgcttcgacgcctactgcttccgagctcatcaccccacgtcacaacatggagacctagagaccccatcctctggggatgagggggagattctgtcagcagaggggcccccagttagagaactggagcccaccctggaggaggaagaggtggtcacccctgacttccaggagcctctggtgtccagtggggaagaagaaaccctgattttggaggagaagcaggagtctcaacagaccctcagccctacccctggggaccccatgctggcctcatggcccactggggaagtgtggctaagcacggtggcccccagccctagcgacatgggggcaggcactgcagcaagttcacacacggaggtggccccaactgaccctatgcctaggagaagggggcgcttcaaagggttgaatgggcgctacttccagcagcaggaaccggagccggggctgcaaggggggatggaggccagcgcccagccccccacctcagaggctgcagtgaaccaaatggagcctccgttggccatggcagtcacagagatgttgggcagtggccagagccggagcccctgggctgatctgaccaatgaggtggatatgcctggagctggttctgctggtggcaagagctccccagagccctggctgtggccccctaccatggtcccacccagcatctcaggccacagcagggcccctgtcctggagctagagaaagccgagggccccagtgccaggccagccaccccagacctgttttggtcccccttggaggccactgtctcagctcccagccctgccccctgggaggcattccctgtggccacctccccagatctccctatgatggccatgctgcgtggtcccaaagagtggatgctaccacaccccacccccatctccaccgaggccaatagagttgaggcacatggtgaggccaccgccacggctccaccctcccctgctgcagagaccaaggtgtattccctgcctctctctttgaccccaacaggacagggtggagaggccatgcccacaacacctgagtcccccagggcagacttcagagaaactggggagaccagccctgctcaggtcaacaaagctgagcactccagctccagcccatggccttctgtaaacaggaatgtggctgtaggttttgtccccactgagactgccactgagccaacgggcctcaggggtatcccggggtctgagtctggggtcttcgacacagcagaaagccccacttctggcttgcaggccactgtagatgaggtgcaggacccctggccctcagtgtacagcaaagggctggatgcaagttccccatctgcccccctggggagccctggagtcttcttggtacccaaagtcaccccaaatttggagccttgggttgctacagatgaaggacccactgtgaatcccatggattccacagtcacgccggcccccagtgatgctagtggaatttgggaacctggatcccaggtgtttgaagaagccgaaagcaccaccttgagccctcaggtggccctggatacaagcattgtgacgcccctcacgaccctggagcagggggacaaggttggagttccagccatgtctacactgggctcctcaagctcccaaccccacccagagccagaggatcaggtggagacccagggaacatcaggagcttcagtgcctccgcatcagagcagtcccctagggaaaccggctgttcctcctgggacaccgactgcagccagtgtgggcgagtctgcctcagtttcctcaggggagcctacggtaccgtgggacccctccagcaccctgctgcctgtcaccctgggcatagaggacttcgaactggaggtcctggcagggagcccgggtgtagagagcttctgggaggaggtggcaagtggagaggagccagccctgccagggacccctatgaatgcaggtgcggaggaggtgcactcagatccctgtgagaacaacccttgtcttcatggagggacatgtaatgccaatggcaccatgtatggctgtagctgtgatcagggcttcgccggggagaactgtgagattgacattgatgactgcctctgcagcccctgtgagaatggaggcacctgtattgatgaggtcaatggctttgtctgcctttgcctccccagctatgggggcagcttttgtgagaaagacaccgagggctgtgaccgcggctggcataagttccagggccactgttaccgctattttgcccaccggagggcatgggaagatgccgagaaggactgccgccgccgctccggccacctgaccagcgtccactcaccggaggaacacagcttcattaatagctttgggcatgaaaacacgtggatcggcctgaacgacaggatcgtggagagagatttccagtggacggacaacaccgggctgcaatttgagaactggcgagagaaccagccggacaatttcttcgcgggtggcgaggactgtgtggtgatggtggcgcatgaaagcgggcgctggaacgatgtcccctgcaactacaacctaccctatgtctgcaagaagggcacagtgctctgtggtccccctccggcagtggagaatgcctcactcatcggtgcccgcaaggccaagaacaatgtccatgccactgtaaggtaccagtgcaatgaaggatttgcccagcaccatgtggtcaccattcgatgccggagcaatggcaagtgggacaggccccaaattgtctgcaccaaacccagacgttcacatcggatgcggggacaccaccaccaccaccaacaccaccaccagcatcaccaccacaaatcccgcaaggagcgcagaaaacacaagaaacacccaacggaggactgggagaaggacgaagggaatttttgctgaagaaccagaaaaaagaaagcacaacacctttcccatgcctcctctggagccttcgcctggggagacagaacccagagagaaacaagagagtccagaagtccctgaaccccaaactgttctcgcaaaaaaaatattcctttgaacaaaggtcttcttttcctttttttacatacacaagatcttcttggcaggtggagccaggtgtctgaaaagttcattctcgtctggctgaactctgggagtgtgtcccagctgagggaagcacaagtagcaaagctcattggtctggtctcttgtttgccaggctgattgaagcaggccttgatgagggtgcatgagtgtatgtttgcattcacatgaaggaattgcttttcacaccagaaattcagacttagtcaatgttggctgaattcctaaatccaggaagaagcctggacgtagggtcattagctttgggaatagaaggctacacagaagcacactgtttttgaacttgacaacagctctccctttaccctggacttcagcccaagttccgtctttggtcttggtggataaacacacagtgtggagatcccacgtactgcattttagggatgtttttaggacaacctccctccatgccttcagagttaggagtgagaatgatcaaagcaatatgtaggtgatggagggagagtgtattgctaacccttccaggtctagtccagcgctgagatttggtggttctgcatgtgtgatgaatctctttcacacaaatagacgagaggatatttagggctagatgagcccagatttcttccccctccatctctcagggagacaaagaacctccttcctggaccaaggaggtgctgccaagttttctagcccagtgcacatacccagtccttaagcagacattggtagtgcccctgccctgggtcccactcctgccccaccccacccttgtccctggccattgcctggtggtctagaaacacttaaaacttgaagtagtgacacctacctgcggtcatattgtagagagatgctcagtgttaaaactgaaacacacaaacacacacacacacacatttttctcttgtagattttaattttttaagtgggaaagaactcaccttgccttcctcccccaaatgtgcaacctgtaaaaggtctctccacaccaggggccaggatccagttccctcatctctggcaggaaagatccacagcttttcctccatgtctgttactcactttcagcagtccgggtaaaatctgtggatcagggttaaaaaagcaccgtggagaatggccctcttcaggaaagaaaaataagcaaatgaatggtccacctaggggttcagtaaagaaagaaatgtgttaactgagcctgaatcccttctgggaagtaataatgaccattgacaactaagaagtagacaccatgctaaagacttacatacaatctccttgaatcttctcaatagcccattgacttagaaactgttactttcccattttacacacagtgaaactgaggctcagatataaaggaaaggtactggcttgaagtcacaaccacgacaggagtaaggatttggaataaggatttggtcctgttttctggaccaaatccttactctggctctgcttacactttctctccatcaccaaatccttactccaaatccagaagtcagagccaactcccatcttggttctgacccaaatcctgctctggactctggagaggagattgaaatataattgcaccctcatacacatttaggaaatggttaagaagtgtaaactgaacccttatccttgtcttcaatcttcctccctgtagacatctatcttattatggttattattcagaaaacccagggatacaggtttgtcttcttactttgataactcttcttagtttaaaataataataataacacatctttggtcatctatgtcacacaaaaattttcctttgtttgcggggggctggggatgcagtgttttttggggggtcttggtttatgctccctgcccttgagcccctcagccgtttgccctgcccccacctcggctccatggtgggagggggctctggtcttttctaaagtgggcggtttgtcttttgatctttcccttttggatgtgcgtgtgtgtctgcgtgtgccatgtgcgtggcacgcatatgagtgtgtgtgcgtgtgaacggctttgggtcctgctggttttgctgtgagctgcagtgttctgtgggtctgtggtatctgacactgtggacattaatgtacttcttggacattttaataaattttttaacagttcaaaaaaaaaaaaaaaaaaaaaaaa

SEQ ID NO: 68 - DNA, 962 bp, Homo sapiens
gcaggctggtaccgctccggatattcccgggatatcgtcgaccacgcgtccgcttataaaaatctgagaaataaaagacctgatgattcctgaacttaccagctaaaatatgctcttcttatacatttattattatcttaaagacagaaaactcctaataaatatctagggtcaaatgcatgcatatcaaacatgaaacaattcagtttatttataagtggtgttggtggatgattatttgtaaattattacacccgttgaaagtataaaacccatttttttcttaaagaacttgtttcattggtttgacaatggttaataactagtgactcttctgctatatgttgatggacaaatacggggacttggcaatgaaagaaaagacagaagaaccaaaaacctcgtgatttctttctggtcaaacttttaaatctggtctgcactcctactttctcactcataaaagaaattatgctagtgaaagtcttgaggttgtatatatttttagtttagaataaatgtaacaggcaaatgctatacctcatctttacagtaacagtaataactactttgtaaatttcactttgggcaggtctctaggatgttttatatgatgatgacatgttccatattgttaccgtgaaaatgaatcttaacattaatggacttggagtttcatcatggttatatggattggggaatttatgattattttttatgttgaaatgtctcatatttgtgttaacacctctttataataaacttttaaattaaaaaaaaaaaaggggggcgctaaaaatacctcaggggccagttaggttcccgtcttttgtaaagggccaaggggcgataataaaaggaggccggtaacgcgctgggaaagtcctggttttgggagacccctctggtggaatggaaccacaataagcagaaaaatagtagtgaaccatctggaagcgtaa

SEQ ID NO: 69 - DNA, 1778 bp, Homo sapiens
tagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatctccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggctgtaatgttccccacctacaaatatgtcgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 70 - DNA, 1667 bp, Homo sapiens
aagcacaggccaccactctgccctggtccacacaagctccggtagcccatggagccctggcctctcctcctgctctttagcctttgctcagctggcctcgtcctgggctccgaacatgagacccgtctggtggcaaagctatttaaagactacagcagcgtggtgcggccagtggaagaccaccgccaggtcgtggaggtcaccgtgggcctgcagctgatacagctcatcaatgtggatgaagtaaatcagatcgtgacaaccaatgtgcgtctgaaacagcaatgggtggattacaacctaaaatggaatccagatgactatggcggtgtgaaaaaaattcacattccttcagaaaagatctggcgcccagaccttgttctctataacaatgcagatggtgactttgctattgtcaagttcaccaaagtgctcctgcagtacactggccacatcacgtggacacctccagccatctttaaaagctactgtgagatcatcgtcacccactttccctttgatgaacagaactgcagcatgaagctgggcacctggacctacgacggctctgtcgtggccatcaacccggaaagcgaccagccagacctgagcaacttcatggagagcggggagtgggtgatcaaggagtcccggggctggaagcactccgtgacctattcctgctgccccgacaccccctacctggacatcacctaccacttcgtcatgcagcgcctgcccctctacttcatcgtcaacgtcatcatcccctgcctgctcttctccttcttaactggcctggtattctacctgcccacagactcaggggagaagatgactctgagcatctctgtcttactgtctttgactgtgttccttctggtcatcgtggagctgatcccctccacgtccagtgctgtgcccttgattggaaaatacatgctgttcaccatggtgttcgtcattgcctccatcatcatcactgtcatcgtcatcaacacacaccaccgctcacccagcacccatgtcatgcccaactgggtgcggaaggtttttatcgacactatcccaaatatcatgtttttctccacaatgaaaagaccatccagagaaaagcaagacaaaaagatttttacagaagacattgatatctctgacatttctggaaagccagggcctccacccatgggcttccactctcccctgatcaaacaccccgaggtgaaaagtgccatcgagggcatcaagtacatcgcagagaccatgaagtcagaccaggagtctaacaatgcggcggcagagtggaagtacgttgcaatggtgatggaccacatactcctcggagtcttcatgcttgtttgcatcatcggaaccctagccgtgtttgcaggtcgactcattgaattaaatcagcaaggatgagcagaaaatgagctgagcttagctctgccctggaacctaccagagcagagaagggcaggagaggaagatttgtctacttgctccactcgcacttatcaaacgtgttatattccatacttattattgatgataagatttacctttatgtaagtttatggccttgaagtgttttcatattgcttctccctttagttctgctgtctccctgaagagtgaaccctctttagtaaatgaaactaatcact

SEQ ID NO: 71 - DNA, 443 bp, Homo sapiens
ttaaatacatcaagtaattttatttctttctagtatattctctccttttagcagtggacagtcttcaactacagcaggaggagcctcaaccaatgaggattgataacaaacttctaggctgtgtctgacaaaccttcagcaatatggcaggctgcaatccggcgccgggcgcccgcactcctcagctcttgggtggtcgatgggactgggcgccgtggagcagggggtggcgctcatcagggaggctcgggccgcacaggagcccatggagtgggtgggaggctcaggcatggcgggctgcaggtcccgagccctgccccgcgggaaggcagctaaggccctgtgagaaatccagcgcagcgccggagggctggcactgctgggggacccattacaccctccgcagccgctggcccaggtgctaagcccctcatttcccgggc

SEQ ID NO: 72 - DNA, 488 bp, Homo sapiens
  misc_feature (18)..(18): n is a, c, g, or t
  misc_feature (119)..(119): n is a, c, g, or t
ttttttttttttttgctnacagtcctttaaggtatgtgtccttaaggttaacttgctacataatatctgtctatgaaaaggttgtgaaccgtgaaccaaaggactttcatgattagtcntatgacacctgaggggacagtaccaggtacccaggtaccaacctggttgaactccaaattattttcaccaaaaaggatgaaacccattttcaaattagtgatatctgactcaagacattaatgtatgtgaaagaaataaacacaaaacttggcttttctaggctcaaagacttctagaagaaacgacttaaaaaaatgccactaagagaggagcaagcttgagataaattgttaataattattgttgtccagtggggattcagaaataccaatcccactccttcgtgagtgttttccttacggtctatttactctggccacaccctgctgctagacaaatttcactttattggattggaaatacaatta

SEQ ID NO: 73 - DNA, 2201 bp, Homo sapiens
ttttttttttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttctttaagaaaacttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttattttttttgtaaaacaatataggagctgtgtctactattaaaagtgaaacattttggcatgtttgttaattctagtttcatttaataacctgtaaggcacgtaagtttaagctttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgc

SEQ ID NO: 74 - DNA, 450 bp, Homo sapiens
tctgaaaataacgtatttatttaatataaccatataccaataattaaatgctcatttaattattatgaagatcacgttcttcaattattcaggatgatcacattattatcaaaggttttcaggtactttattttcttacctgcccctaccatagtccccattctgttccacctgcaaagtggaagtctccttctgaaggtaagtttgctcctgatgcccagttactgtggggttatgccgttcagctggaaagtttcttgaactatatctgttcaactgtccatcccccaaggatacagagccctctgttgagtgttctgaaccaccagatgacctaaactgaggcttcacacgatttttttggaatggtcgacccatattcatagcagcagcatttgttttataagatcctggcgaattaaagccattcacaaaactaccattgggaaa

SEQ ID NO: 75 - DNA, 2062 bp, Homo sapiens
tgtttaacacagtgtagcttaactggttaaagcaccgggctagtaaacacatgactaggggctcaatcccttgtgggcctgttagtttatttactgcattcattggccacagacttcatccctaaagtggtcaagccatctcagacacgtttgcttctggtcacaccgatcaagattgatccagccactgaagtaatccaaacaactcacttctaatgggccagaggttgtcatcttcatacctgaggaatggcttgcattttataaaaattggagattcttctgctctcagaatagcagacacagggctgggcgcagtggctcatgcctgtaatcccagcactttgggaggccgaggcgggcggatcgcctgaggtgtcaggagtttgagaccagcctaaccagtgtggtgagaccccgtctctactaaggatacaaaaattagccgggcgtggcggtgggcgcctgtggtcccagctactcgggaggctgagaaagaattgcttgaacctgggaggccgaggttgcagtgagccgagattgtgccattgcactccagcctgggcgacagagcaagattctgtctcaaaaaaaaaaaaaaaaaaaaaaaaaaaagcagacacagaggtgaacttaacctgagattaaccagattcacagttcaatagcaaccacctttagagtccctaagctaagaaactgctatgattttgatgaaacagaaaggaggaaggtaactctagttctttctgaggcatccgacactcctttagaagggttttcccaggaagcctcattcactttcaggtaagcccattatgaagggataaggattttaccgtattccactggaataggggaaaaaaccatctcactttaacagaaagcatgcaagtgcccttttctggaggaggtgggaatgagggagtacacagactttagcttaaactgtggcaggagggtcttaattttggcagaacagggcatggtgttgcatctcacctgttccacgcttagtacaagcccttcttcccagtccctgtcacctgcctcattttgagctttcactgtattttcctgttgttccagggaagatgaagtgcatttaaatgctgcagttggatactgtgaagatgagaccccttagcctgtgggattaactttccatggagcccattctggagagacttgagagagcacctttaaaaggaagttagctaagatactgccctccgtttcagacagaggttggaaccagatcctggctgagagcagagaccagcttccactcagccatgcaccctaggagtggggattcagctctgtggctccaggaaggttaatcttcaatgttaatccgtttagataaagttgttagttaaaaggtaatctgtttagcctccctttccccattctcctgccagaaaagagggagttcaagtcttctttccaggactcctgtgttttggctgagactgattcttcactgtggccttgggagaaaagctgcctaaccagttctgggccctggctagttacaaccatgtgtgagttgtttacagtacgcacaggtatgggctgaagggaaacaaagcttaagggatgactagaaaggcttgctgaaattgctatgggagggccccaccctccaagccatctcccctcacaccccgctcggtttcagtttctgcagcttggttatgcgacattctcttaatccttttttgaatctggtctctacttaagcactcaagaaaactgctccacaaggattgttttagtggggttttaattttttaaaatgttcttgtttatttaaattgcttgaacaagggtttagctgtatgggaagagttcctgcctttagctatacatgtttccacccacttagacatgctgctcacccacagactcatacagcctccacagacacaaagcttctgtgtatcctacatgtacctgcaccccaattctgtcaacctccccacagctcttgactggctgtttatctattccattccactaccttcccaccccagccctcaaagtcccaaacagattg

SEQ ID NO: 76 - DNA, 3780 bp, Homo sapiens
tactggacaaacatttcctccaaggacacagctctctgcctccatgtcaccacctttgaaggactgactgattccctcggctggtgccagtgcctgctcctgccatggggcccgcggggagcctgctgggcagcggacagatgcagatcaccctgtggggaagtctggcagctgtcgccattttcttcgtcatcaccttcctcatcttcccgtgctctagttgtgacagggaaaagaagccgcgacagcatagtggggaccatgagaacctgatgaacgtgccttcagacaaggagatgttcagccgttcagttactagcctggcaacagatgctcctgccagcagtgagcagaatggggcactcaccaatggggacattctttcagaggacagtactctgacctgcatgcagcattacgaggaagtccagacatcggcctcggatctgctggattcccaggacagcacagggaaaccaaaatgtcatcagagtcgggagctgcccagaatccctcccgagagcgcagtggataccatgctcacggcgagaagtgtggacggggaccaggggctggggatggaagggccctatgaagtgctcaaggacagctcctcccaagaaaacatggtggaggactgcttgtatgaaactgtgaaggagatcaaggaggtggctgcagctgcacacctggagaaaggccacagtggcaaggcaaaatctacttctgcctcgaaagagctcccagggccccagactgaaggcaaagctgagtttgctgaatatgcctcggtggacagaaacaaaaaatgtcgtcaaagtgttaatgtagagagtatccttggaaattcatgtgatccagaagaggaggccccaccacctgtccctgttaagcttctggacgagaatgaaaaccttcaggagaaggaagggggagaggcggaagagagtgccacagacacgaccagtgaaactaacaagagatttagctcattgtcatacaagtctcgggaagaagaccccactctcacagaagaagagatctcagctatgtactcatcagtaaataaacctggacagttagtgaataaatcggggcagtcgcttacagttccggagtccacctacacctccattcaaggggacccacagaggtcaccctcctcctgtaatgatctctatgctactgttaaagacttcgaaaaaactccaaacagcacacttccaccagcagggaggcccagcgaggagccagagcctgattatgaagcgatacagactctcaacagagaggaagaaaaggccaccctggggaccaatggccaccacggtctcgtcccaaaggagaacgactacgagagcataagtgacttgcagcaaggcagagatattaccaggctctagcaacccagaagacaaccctgggtagcctgtgatcagtgtctggagacgtttcttctgtggaagagaagaagtgacacaaacctatacttcatatgctgctttagtcacctgaagatggttggagaggccctgtcgactgttctcccagttgttcagtttctgagacagagaggtacggactaggctgcacctgagtgtgcccctgcctgccagatggacaggtacacccaagcacatctccctgctgcaccctcaccacccacaaaagatcccagctgtcagtggtctcatctcattagtgaggaaagccaagctgtatggaaaagctgcactcaccaaggaccacaatgcccccggcctaaagtactgccattcagaaaagcaggtttttcttcctctctttccttttctctgtctgctactgactttaaggctttttcccccttgaaatgtccagattcctgtggttcatcccaaggaaattttcacacaaagcttggcctttgccctcaatataggtgttttaggatggtgacaaaccatggctgctgctttctgcccagctcgccagtcctccccaaagagttgcgcatcagcacctggggatctggaccctgcgggtgaagggatggggagggacgtccctggagtctcttctgtctttgttccttcttattttggcattcgatatcagcagcctctccccaaagtacttgaagtcagttttagatgctttattttatttttctagtcaaaaacgtgtttcccccagtgtttgaaaactcgtccgaatcttttcagtattttccatgagtattgtggtacttctagacttgtttaagcccagaactcattccttcaaaacagagagccttaatctttatgttgggacacagaccacatatttggacggcagccatgcatccatcgctgaagggctgtggacatgaatgtgtatttcccatggtctccgctgcccacaccaacagtgtggcatctcataagttaactgctaccctaaggtaatctaagattaaaatgtaaacatttatttttgttatgtaagtttataagatgttttatgttcaatgcctaatttctcaaaagtgccagaaaaaaatgtatattagctattttgattttatgtacaatgatttatactctccttttgaaaagataccataaagcacataagctagatcactacaaggagctgttatcttttttctaatcaagtgtttaaaacactgatggtttttaaagactcacctttttaaatggtacttggagctcctgattcaaattacctagaccccctagagaaataaatggaatatacataaataatcattttcagtggtttatggtgggcaatattgcaatatttgaaatggtaaaaatggaaagaagaacaaaatatgatgagaggtggctgtgaattataaacctcataaaagtgtcataattccattaaggtttaattatattttttcagaaaacagtgatgaattctgtagtccagtgcttgccaatgcaaattgcctattggaatcttcttcctatattttacaaacatcagtggctgaaatagctcagagtaagagctcagcctggtttgaatttaatcatctctttagatcttataaggccagcattaggaaacttgttcacttttcattttcaaaggagcctagttgaagtgctattatgagtgtgggctatggaaagacagcttttcctacactgataaagaaaaaaaatgaggaaattatttcatccccttgtgacatctgtgactttttggatttaataatcttgctgtttttcctctttatgacaaagaatataattgggaggatgaagtgtcttaaaaattgtagagaccagctcactggaatgtttttccatccctgtattcatggcttgactttgtgactgctctacactgcatgtctgacattgcagagtgagctatgttgaggtaaactggttggttgtcattattttgcaatcagcctggtctctcccatgaagatgtcgtgtgcataagcacaatcatcactgattagaagatcacagcagaatacccttggattagagagaagttcgtaccttgcatttctctgaattctagtctctcataagcactgctttgctggatgattttcactgctttgtgttaatgactttgagcgatctctcacatgatggggttctttagtacatggtaacagccatgtcatcttacacacctagcattgtgaatgctgtagtgacatcctttataggcaccttacagctcaaaacttttgtttcatttcatgccttacttatcaaaaaggcaggaaagtaggtatgatctctaaagtaaaaaaaa

SEQ ID NO: 77 - DNA, 9586 bp, Homo sapiens; identical to SEQ ID NO: 14

SEQ ID NO: 78 - DNA, 2051 bp, Homo sapiens
cggcgccgagtagccgggccgggccggagcgcgggcgcggcggaggcagctgcgcccggctcctcccctcccaggccccgccccccgcccgggccccggcgatggtgacacatgcggcggcggccgcgcggcaggaccatggttgagcgcgccagcaagttcgtgctggtggtggcgggctcggtgtgcttcatgctcatcttgtaccagtacgcgggcccaggactgagcctgggcgcgcccggcggccgcgcgccgcccgacgacctgtacctgttccccacgcccgacccccactacgagaagaagtactacttcccggtccgcgagctggagcgctcgctgcgcttcgacatgaagggcgacgacgtgatcgtcttcctgcacatccagaagacgggcggcaccaccttcggccgccacctcgtgcagaacgtacgcctcgaggtgccgtgcgactgccggcccggccagaagaagtgcacctgctaccggcccaaccgccgcgagacttggctcttctcccgcttctccaccggctggagctgcgggctgcacgccgactggaccgagctcaccaactgcgtgcccggcgtgctggaccgccgcgactccgccgcgctgcgcacgcccaggaagttctactacatcaccctgctacgagaccccgtgtcccgctacctgagcgagtggcggcatgtgcagaggggtgccacgtggaagacgtctttgcatatgtgtgatgggcgcacgcccacgcctgaggagctgccgccctgctacgagggcacggactggtcgggctgcacgctacaggagttcatggactgcccgtacaacctggccaacaaccgccaggtgcgcatgctggccgacctgagcctggtgggctgctacaacctgtccttcatccccgagggcaagcgggcccagctgctgctcgagagcgccaagaagaacctgcggggcatggccttcttcggcctgaccgagttccagcgcaagacgcagtacctgttcgagcggacgttcaacctcaagttcatccggcccttcatgcagtacaatagcacgcgggcgggcggcgtggaggtggatgaagacaccatccggcgcatcgaggagctcaacgacctggacatgcagctgtacgactacgccaaggacctcttccagcagcgctaccagtacaagcggcagctggagcgcagggagcagcgcctgaggagccgcgaggagcgtctgctgcaccgggccaaggaggcactgccgcgggaggatgccgacgagccgggccgcgtgcccaccgaggactacatgagccacatcattgagaagtggtagtggcggtggtggccacggggaggcctcttggggggtgtgggggataaaacaggacagacgacaggtccacccaagactgtcaagggatgagcatcccaaacctgctccacagaggtagctgcgtcctgaaaaaaaacagagcagggatgtagtggggctgggcagggatgggggcttgagaaatcaacaggtgcagcccagtgggtcagaggaaagcgtgctcgaaggatgccatggtcagggcagggcctccagagcaggtgttgtgcctggagctgctctcctggcctccttggatttatcgcaaaaactgaaggtttgcgcaagagacgaggacagcggaaagtggacctgccaggccgggagtgtgtccctcaccaactatgcacacagcactcgctcttaactcctctgtccgggctactaggagtgagaccagcttctggcaactgccccagctccaggccatcccatagcccctcctcttctggctgcccccaatgccccgaggcctggggagcccccagctcacccatctgtagctccctcaaagtcagggcccaccccatctgaggcagagaagactcgagtccagcccccaggaagcctgctcccctctctggcccatggtcctgcttcatgctttgggtcaggaggccaaagctgatgttcaggccccacccactccctacagtcctcagaccccg

SEQ ID NO: 79 - DNA, 634 bp, Homo sapiens
aaatgacagacataaactaaattgtaaaagctagtttgtcaactatcaattttgagttccatatatataaaaatcatgacttaaagataatcttaccaatactagaaatcaagaaatacatcaaataaaaggaaactctaaaattccatcttaacttataaatcactttgcacattttacttacaaagtaagattttccttatttttttcttcatcttgattccacgctatcaactataagttgcatatgtttgcactgtatttttattaggtggctcaagtccattgtggtacaaagtaaaatataaatgattaagacaaaatgcaaagaaatagcaaaattaattttacagaaaatttcttctagtttaaattgtttttttaaaaggccactacaatatgcttcaaaaaaaatcccatatgcctccacccattatgtatgttttgtctcttaacatttcactgtttccatgcaatgctaaattaaaacaatcagatcagcactgaaaaacacacacaagaactttaggcctagactcaggcatagtgacatcaagttttaagtgtaaatatggcattaagaattcaacagtttttcttcattagagcttttcttcttttggtctgggagagt

SEQ ID NO: 80 - DNA, 5552 bp, Homo sapiens
gtgatgagatataatgcatcctccagtccatgcacgcttcctcttgcaatttgggcatcattcctcagtggaaacctttaaaccctgaaatccaggaaaagaaaataaatacattatcatggacctgagggatttttacctgttggctgctctgattgcctgtttaaggctggattccgcaatagctcaagaacttatttacactattagagaggaattgcctgaaaatgtgcccataggaaacataccaaaggatctgaacatttctcacatcaatgctgccacagggaccagcgccagccttgtctacagactggtttctaaagctggggatgcccctttggtgaaagtatccagcagcactggggaaattttcacaacctccaacagaatagacagagaaaaactctgtgctggcgcctcatatgctgaggagaatgagtgtttctttgaacttgaggtggtgatcctccccaatgatttcttcaggctgatcaaaataaaaataattgtcaaggataccaatgataatgcccccatgtttccatctcctgtcatcaatatttccattccagaaaacactttgatcaacagccgctttccaattccatcagcaacagatcctgacacaggcttcaatggtgtacagcattatgaattgttaaatgggcagagtgtttttggactggatatcgtggaaactccagagggagagaagtggccacaactgattgttcagcaaaacttggatagagaacagaaagatacctatgtgatgaaaatcaaagtagaggatggaggcactccacagaaatccagtacggccatactgcaggtcacagtaagtgatgtaaatgacaacaggccagtgtttaaagagggtcaagtggaggtgcatattccagagaatgctcccgtaggtacctctgtaattcagctccatgccactgatgcagatataggcagtaatgctgaaatccggtacatttttggtgcccaggtcgcccctgcaaccaaaagactctttgctttaaataatactactgggctgattacagttcagaggtccttagatagagaggagacagccattcacaaagtgacagtgctggctagtgacggcagctccactcctgctcgagcaacggttaccatcaatgtcaccgatgtaaatgataaccctcctaatatagacctcaggtacattataagtcccatcaatggcaccgtgtatttatctgagaaagatcctgtcaatacaaagattgccctaattacagtttcagataaggacacagatgtgaatggcaaagtgatctgttttattgaaagagaggtcccatttcatttgaaggcggtatatgacaaccaatatttgttagagacctcttctttgttggactatgagggcaccaaagaattcagctttaaaattgttgcctctgattctgggaagcccagtttaaatcagactgccctggtaagggttaagcttgaggatgaaaatgacaacccaccaattttcaaccagcctgtaattgagctgtcagtttctgaaaacaaccgacgtgggttatacttaacaactattagtgccacagatgaagacagtgggaaaaatgcagacattgtttatcagcttggaccgaatgcctccttctttgatctggaccgaaaaacaggagttttgacagcctccagagtatttgacagagaagaacaagaacgattcatttttacagtaactgccagggataatgggacccctcccctccaaagccaagcggctgtgattgttactgttctggatgagaatgacaatagccccaagtttactcataatcattttcaattttttgtgtctgagaatctgccaaagtatagtactgtgggggtaatcacagtgacagatgcagatgctggagagaataaagctgtgactctttccattctaaatgacaatgataattttgtgttggatccctattctggagtcataaagtcaaatgtctcatttgatagagagcagcagagttcctacacttttgatgtcaaagccactgatggaggacaaccacctcgttcctctactgcaaaagtaactatcaacgtcatggatgtcaatgacaacagcccagttgtcatttctccaccgtctaatacttcctttaagttggtgcccctctcagccattcctggctccgtggtagcagaagtttttgcagtggatgttgacactggaatgaacgctgaactaaagtatactatagtgagtggaaacaataaaggcttattccggattgatccagtaacaggtaacattactctggaagaaaaaccagcacctactgatgtgggattgcatcgtttggtggtcaacataagtgacctggggtaccctaagtctttgcacacgcttgtgcttgtattcctttatgttaacgacactgctggaaatgcctcctatatctatgacttgatccgcaggactatggagaccccgttggacaggaacataggggatagtagccaaccctatcaaaatgaggactatctaaccatcatgattgccatcatcgccggtgccatggtggtcattgttgtgatcttcgtcaccgttctggtgcgctgtcgccatgcatcaaggttcaaagcagctcagaggagcaagcaaggtgccgaatggatgtccccaaaccaggagaacaagcaaaacaagaaaaagaaaagaaagaaaaggaagtctcccaaaagctctcttttgaactttgttactatcgaagagtccaaacccgatgatgcagttcatgaacctatcaatgggacaataagcctgccggctgaactggaggagcaaagtataggaagatttgactggggcccggcacctccaacaacattcaagcctaacagtcctgacctggccaagcactacaaatctgcttctccacagcctgcttttcatctcaaaccagacactccagtttccgtgaaaaagcaccacgtgattcaggaactccctttggacaacacctttgttgggggttgtgacaccctttctaaacgctcttccactagttcagatcacttcagtgcctcagagtgcagttcccaaggaggcttcaagacaaagggccccttacacaccagacagtcgcagcgccgtgttacgtttcatctccctgatggctcccaggaaagctgcagtgacagtggtctaggagaccatgagccggtgggtagtggaaccctgatctcacaccctcttcctctggttcagccacaggacgaattctatgaccaggcctctccggacaagaggactgaagcagatggcaactctgatcccaactctgatgggcctttgggtccccgaggattagctgaagctacagagatgtgcactcaagagtgcttggttttgggtcactctgataattgctggatgcctcctggcttgggtccatatcaacaccccaaatctcctctctcaacctttgcaccccagaaagaatgggtgaagaaggacaagcttgtgaatgggcacaccctgaccagagcctggaaagaagacagcaacaggaaccagttcaatgaccgtaagcagtatggctccaatgaaggccatttcaacaatggcagccacatgacagacattcctctggcaaatctgaagtcttataagcaagcaggaggtgctactgagagtcctaaggagcaccaactctaagaaaaggctatatgggacctaataactttaaatagacatgctaataccgtgtgcgtcagagctttatgtattcaatagatctctacaactatgccccttctagcagggatacctataactttgtgttagcaccatggagaatacaatgtttttgcaacatatgagagaagatagttctagccatgcaattttgtttactagaattgattacactctccagagatctctccattgtgcaaattttttttattattgcattttattttgaccctggactgctgctatgaacaatagaatatgcatttggaaagtaagaaagtttcatggattagagtgactgaaaaacatatccagttagaaaattgtgcttttttttttttttttttttgtcattgatttgtgctgggactgctatacttgacattatactgcaaacaaaacttaaagagataagcattaaacctattgtgctgttaacaacgttagtggacacttgtaagtcaatcagtgttaaagtatttgtaaatagaagcaagctattattaacaacttttgtgtacttataatgttcacctaaaaatgttgtagcataattctgtgttttatggttgcttctgtccttctttttatttacctctttgttgttatttttgttgcttctttcagtgaggtgtttctgtgttagtagtctgtcttgacacacattgttcaaacaatctcaagcacttgtgtttaaaaaaggttctgaaatcttgcttctcatatgatagcttatgatgccggaattctgtaaacaataaagatgaaagaaaaaatgaaaactttatacaaaaaaggacttctgcaaaagcttggaaattcagaacctattttttatcatcttattttcaaagtaggcaaaagcaaaatcacttaattagcaccattaagtgagagagtaatggaaaacggttatccaccaaaagtgatataatatcctgtacttgtcactcatgtaaaactaatgtatcaaaattagcatatatggaagaaaaatcactattcaaaaatagtttcaattgggcaaatgtgtgtctacaactttgttgaaatggcacagtctgtgttgatcctcatatacaataatgttgttgtaacacaagtgttattagaccatagccacaaaatatttaatgtgttgtgccttcatgatgtaacagaacattctccaggtagggtagttgggggaaataaagggataaatctctaattattgctgtttaactgtttgttatcatagttggtcaatgcctggcaggtaccagcatattgtcacttaggtcaaaccaataaagtggcaactaatgttaataagatttcagttgcacgtgcaaacaaatccaaattcgaacattcttagaaggtttttgttaaggcatgacagatgatttaaacaaataaatagcatgcaacaaaatgtctttattgaaagaagtggaagttatcttaatgccacggttcaccatcaatttaaaagtaaaaaaaccaaaaaaaaaacaaaaaatttaaaaaaaaggtttgctaatctgatagttaatttgttcttaccaaaaaataaaattactttgtaaatagcagttcacatttttccacagtataatggaaaataatgggtaggggtgcattgcttattgaagtacatttttgtcggtttgtgaggggtgtttgatgactttgacagaataaatatctaaacaattatccttgttactgctttgccagttctacgttatttacaattattcagctcttgcaataaatgttctgaattcctgaaaaaaaa

SEQ ID NO: 81 - DNA, 1018 bp, Homo sapiens
  misc_feature (198)..(200): n is a, c, g, or t
  misc_feature (202)..(206): n is a, c, g, or t
  misc_feature (209)..(210): n is a, c, g, or t
  misc_feature (214)..(214): n is a, c, g, or t
  misc_feature (216)..(217): n is a, c, g, or t
  misc_feature (219)..(219): n is a, c, g, or t
  misc_feature (221)..(221): n is a, c, g, or t
  misc_feature (223)..(224): n is a, c, g, or t
  misc_feature (227)..(228): n is a, c, g, or t
  misc_feature (230)..(232): n is a, c, g, or t
  misc_feature (235)..(235): n is a, c, g, or t
  misc_feature (237)..(238): n is a, c, g, or t
  misc_feature (241)..(241): n is a, c, g, or t
  misc_feature (247)..(247): n is a, c, g, or t
  misc_feature (256)..(256): n is a, c, g, or t
  misc_feature (265)..(265): n is a, c, g, or t
  misc_feature (268)..(268): n is a, c, g, or t
  misc_feature (275)..(275): n is a, c, g, or t
  misc_feature (280)..(280): n is a, c, g, or t
  misc_feature (314)..(314): n is a, c, g, or t
  misc_feature (320)..(322): n is a, c, g, or t
  misc_feature (328)..(329): n is a, c, g, or t
  misc_feature (336)..(338): n is a, c, g, or t
  misc_feature (355)..(356): n is a, c, g, or t
  misc_feature (360)..(360): n is a, c, g, or t
  misc_feature (367)..(367): n is a, c, g, or t
  misc_feature (371)..(371): n is a, c, g, or t
  misc_feature (378)..(378): n is a, c, g, or t
  misc_feature (394)..(394): n is a, c, g, or t
  misc_feature (412)..(412): n is a, c, g, or t
  misc_feature (419)..(419): n is a, c, g, or t
  misc_feature (453)..(453): n is a, c, g, or t
  misc_feature (457)..(457): n is a, c, g, or t
  misc_feature (460)..(460): n is a, c, g, or t
  misc_feature (466)..(466): n is a, c, g, or t
  misc_feature (481)..(481): n is a, c, g, or t
  misc_feature (512)..(512): n is a, c, g, or t
  misc_feature (516)..(516): n is a, c, g, or t
  misc_feature (528)..(528): n is a, c, g, or t
  misc_feature (535)..(535): n is a, c, g, or t
  misc_feature (541)..(543): n is a, c, g, or t
  misc_feature (572)..(572): n is a, c, g, or t
  misc_feature (621)..(621): n is a, c, g, or t
  misc_feature (691)..(691): n is a, c, g, or t
  misc_feature (791)..(791): n is a, c, g, or t
gggtgagccatgggtaatttttaatgccatccagtgaaaccatcccctgccttccaaggctacttcatgctttagtatccagtggtggcctccacagacaagattaatgctgggagggcaccagtgccccttgcttgtagtgggaggatggaagataggtaggtaggtaggtaggtaggtaggtaggtaggtaggtannnannnnnatnnttgncnnangntnnatnntnnntanannaangtgaanaaaattaantgaaatatnacnaggtatnaagtnattatttggtagtggggggaaagtgtgaatattnatggannngaaaannttctcannnaatttgatgaaagttgnntgangggtcanagtnatggagntaaaggatgtgaaggnatagagggttatattttnagtttantggaagataaaggggaagtgaattttggaaggtnattnaanaaattnaagtgtgaaaataanaatattgagtggtgaaattgggaatttgtanatantagtgattatgnaaattantaaagnnnttttggggggggggatggtgggtgatgantataattgtaggagtttggggaaagtgaaaaaggaaaattatttgaggntagggagtttgaaattagtaagggtaatattaatgagaatttggtttttataaaaaaatttgtaaattanatggggggtggggaatggggagttggaagttaaaagataattaggaattgagttgggaaagattttttgaaaattgggaaatttaaggtttaaattgagntggaattaaaaagggtgtggatttgaggattgggggaaaagaaggggaaaaattggtgttaaaaaaataaaaagatgtgataagtgaatggttttttttgttaaagggagtaattagtttgttaagtaaaagagtttgggggagatatagggaattttggaaggagggggggtaaaagaagtaaggggggtgaagtgagtttgtttgaggtgggggagaataagaaa

SEQ ID NO: 82 - DNA, 1021 bp, Homo sapiens
tgattaccaatttaatacgactcactatagggaatttggccctcgaggccaagaattcggcacgaggtgtaaaatattttgacttttataataatgcgaagtagttttatttgcattaatcaataatgttcaggatctttttgtagtaagtatattttaaatggtgtaatttgtgtgtttatgatatgtattcaattatttaagttaagtatcagtgtatttttaaaaagtgttcccaggtgaacaaaagtttgcttttcttcaccattctgtacaggacaagcattattcagttcacatagtcagctctcactacacttcaacagaacggggcaagttcgtatttgaattctgttatatttatctaggggaagcaaaattaaccttttaataatagattatctttaatggttattaaaagaatgttattgaccaaaaagacatattttgagattaataaagatgtattagattatccaaaaaaaaaaaaaaaaaaggacgcggccgcaagcttattccctttagtgagggttaattttagcttggcactggccgtcgttttacaacgtcgtgactgggaaaaccctggggttacccaacttaatcgccttgcaggacatccccctttcgccagctggcgtaatagcgaagaggcccgcaccgatcgcccttcccaaaagttgcgcagcctgaatggtgaatgggacgcgccgtgtagcggcgcattaagcgcgggggggtgtggtgtgtactcgcagcgtgaccgctacacgtgccagggcctaatgcccgctccttccgctttcttcccttcatttctcggcacgttcgccgggtttccgcgtcaaccctctaatccggggctcccttatggttcgacttatggctcaggcacctcgccctaaaatttgttagggtaaggtcacgatgggcacccctgaaaggggtttccctttgcttagaccaatcttaaagggatcttgtaaatgaaaaaaaaccgaccggcatttttgttaaggga

SEQ ID NO: 83 - DNA, 3783 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttcgaatctaccatggttcccatgggctggagcatattgctaggagggtacataatgccactttgattttgtcagaaggtctcaagcgagcagggcatcaactccagcatgacctgttctttgataccttgaagattcattgtggctgctcagtgaaggaggtcttgggcagggcggctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcatgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggttttttttttttttaatctgcatttattagtattctaataaaagcattttgatcggaaaaaaaaaaaaaaaaaaaaa

SEQ ID NO: 84 - DNA, 2015 bp, Homo sapiens
actgcgaagcggcttcttcagagcacgggctggaactggcaggcaccgcgagcccctagcacccgacaagctgagtgtgcaggacgagtccccaccacacccacaccacagccgctgaatgaggcttccaggcgtccgctcgcggcccgcagagccccgccgtgggtccgcccgctgaggcgcccccagccagtgcgcttacctgccagactgcgcgccatggggcaacccgggaacggcagcgccttcttgctggcacccaatagaagccatgcgccggaccacgacgtcacgcagcaaagggacgaggtgtgggtggtgggcatgggcatcgtcatgtctctcatcgtcctggccatcgtgtttggcaatgtgctggtcatcacagccattgccaagttcgagcgtctgcagacggtcaccaactacttcatcacttcactggcctgtgctgatctggtcatgggcctggcagtggtgccctttggggccgcccatattcttatgaaaatgtggacttttggcaacttctggtgcgagttttggacttccattgatgtgctgtgcgtcacggccagcattgagaccctgtgcgtgatcgcagtggatcgctactttgccattacttcacctttcaagtaccagagcctgctgaccaagaataaggcccgggtgatcattctgatggtgtggattgtgtcaggccttacctccttcttgcccattcagatgcactggtaccgggccacccaccaggaagccatcaactgctatgccaatgagacctgctgtgacttcttcacgaaccaagcctatgccattgcctcttccatcgtgtccttctacgttcccctggtgatcatggtcttcgtctactccagggtctttcaggaggccaaaaggcagctccagaagattgacaaatctgagggccgcttccatgtccagaaccttagccaggtggagcaggatgggcggacggggcatggactccgcagatcttccaagttctgcttgaaggagcacaaagccctcaagacgttaggcatcatcatgggcactttcaccctctgctggctgcccttcttcatcgttaacattgtgcatgtgatccaggataacctcatccgtaaggaagtttacatcctcctaaattggataggctatgtcaattctggtttcaatccccttatctactgccggagcccagatttcaggattgccttccaggagcttctgtgcctgcgcaggtcttctttgaaggcctatgggaatggctactccagcaacggcaacacaggggagcagagtggatatcacgtggaacaggagaaagaaaataaactgctgtgtgaagacctcccaggcacggaagactttgtgggccatcaaggtactgtgcctagcgataacattgattcacaagggaggaattgtagtacaaatgactcactgctgtaaagcagtttttctacttttaaagacccccccccccccaacagaacactaaacagactatttaacttgagggtaataaacttagaataaaattgtaaaaattgtatagagatatgcagaaggaagggcatccttctgccttttttatttttttaagctgtaaaaagagagaaaacttatttgagtgattatttgttatttgtacagttcagttcctctttgcatggaatttgtaagtttatgtctaaagagctttagtcctagaggacctgagtctgctatattttcatgacttttccatgtatctacctcactattcaagtattaggggtaatatattgctgctggtaatttgtatctgaaggagattttccttcctacacccttggacttgaggattttgagtatctcggacctttcagctgtgaacatggactcttcccccactcctcttatttgctcacacggggtattttaggcagggatttgaggagcagcttcagttgttttcccgagcaaaggtctaaagtttacagtaaataaaatgtttgaccatg

SEQ ID NO: 85 - DNA, 1538 bp, Homo sapiens
atggatgggggaaccgggcggcgagacggcggcaggacggcggcaggatgtgtgaccggaatggtggtcggcggcttcgacagtggctgatcgagcagattgacagtagcatgtatccaggactgatttgggagaatgaggagaagagcatgttccggatcccttggaaacacgctggcaagcaagattataatcaggaagtggatgcctccatttttaaggcctgggcagtttttaaagggaagtttaaagaaggggacaaagctgaaccagccacttggaagacgaggttacgctgtgctttgaataagagcccagattttgaggaagtgacggaccggtcccaactggacatttccgagccatacaaagtttaccgaattgttcctgaggaagagcaaaaatgcaaactaggcgtggcaactgctggctgcgtgaatgaagttacagagatggagtgcggtcgctctgaaatcgacgagctgatcaaggagccttctgtggacgattacatggggatgatcaaaaggagcccttccccgccggaggcctgtcggagtcagctccttccagactggtgggcgcagcagcccagcacaggcgtgccgctggtgacggggtacaccacctacgacgcgcaccattcagcattctcccagatggtgatcagcttctactatgggggcaagctggtgggccaggccaccaccacctgccccgagggctgccgcctgtccctgagccagcctgggctgcccggcaccaagctgtatgggcccgagggcctggagctggtgcgcttcccgccggccgacgccatccccagcgagcgacagaggcaggtgacgcggaagctgttcgggcacctggagcgcggggtgctgctgcacagcagccggcagggcgtgttcgtcaagcggctgtgccagggccgcgtgttctgcagcggcaacgccgtggtgtgcaaaggcaggcccaacaagctggagcgtgatgaggtggtccaggtcttcgacaccagccagttcttccgagagctgcagcagttctataacagccagggccggcttcctgacggcagggtggtgctgtgctttggggaagagtttccggatatggcccccttgcgctccaaactcattctcgtgcagattgagcagctgtatgtccggcaactggcagaagaggctgggaagagctgtggagccggctctgtgatgcaggcccccgaggagccgccgccagaccaggtcttccggatgtttccagatatttgtgcctcacaccagagatcatttttcagagaaaaccaacagatcaccgtctaagtgcgtcgcttgggcgccccaccccgtctgcgtcctgcatccatctccctgttacagtggcccgcatcatgattaaagaatgtggatccctctgtctggggtgggatgccttactttgcacttaatttaataagggcattctcggaggagtagacgtttaatacgaagtggcgcatagccctgccgagatgtcggtgatggcctgatgcg

SEQ ID NO: 86 - DNA, 1099 bp, Homo sapiens
tcctgcgttgctgggaagttctggaaggaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagattgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatttgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcaccaggacagagactgtataggctgaccagaagcatgctgctgaattatcaacgaggattttcaagttaacttttaaatactggttattatttaattttatatccctttgttgttttctagtacacagagatatagagatacacatgcttttttcccacccaaaattgtgacaacattatgtgaatgttttattattttttaaaataaacatttgatataattatcaattaactgaaaaaaaaaaaaaaaaaaaaaaaaaaaaaaa

SEQ ID NO: 87 - DNA, 1878 bp, Homo sapiens
ctctgactaccttgcctatgaacttttctttgaaattatgcttttctatgagaatttgtatattttttgttgatgtttctagccttttagcctgatgataggacctttgagtgtctgtctaggatacattggtaggtaagggtagaccatgatcatttttggcagaaatgaagcctgtttccagaaggcacgttcctccatgattttcctgaacatttttggttgatgacttgggggtcagggaatccattcaggtgagaggttagttttttggtcttcaaattggaagagcaactttagcctttgatttgtattatcttctcacagcaactattatgttgactgcctgtacatgccttcaataccatgtaaacctagtttatcttttgtatatttgatttcttagatggttagagctgcctgtaatcccagcactttgggaggccgaggtgggcagacctcatgatctactaaataagagaaattttctcttattaataagaaaaacccatctctactaaaataagaaaaaatagctgggcatggtggtgcacgccagtagttccagctactcgggaggccaaggaaggggaatcgcttgaacccgagaggcggaggttgcagtgaactgagatcgtgccactgcagtccagcctggacagagcaagattctgtttcaaaaaaaaaaaaaaggattgttagagctgtttcctgttcttttatatgtgttgtgttttccttgtacataatattttgaaaactttaactattcatgccagattttgttccctgtttaaaagtgtgtttctgtgtcagtgaacttttacatattttatatacaaacatacccatttgtattgttactcaaaaacttttgaaaaatgcttgttactttcctaaaataaggtgagcttatattgcgaacaaaatcgtattatttcagaggcattccatttgggacatttactgtactacagggaatctctcatttcaaaatgacctgtgttgcagttattgtttataaaactgttcatttatctgacataaggggctaatcaaactgcttaagtacattcctggatgtttggaagatttttaagcgccatagagagggtacttatgctatggaaattgtgtttatatatatatgcataattgccactgaaattctgaacagacccaaaggaagaaaaatactgtgatttaaataaagctaacataattaatttatatctattttatatttgacttagtgggataaattgttttgtggaaaaccatattataaaatagtctaagttttttatagttgaggaagaatttgaggtgaaagatcatgttaattgtaacaattgccagtactttgtgttcactatgtgtctggcactgatttatgtttattaatttactacatcctcagaacaattcagtgaagtaggtattactaatattcttactttgagattatgaaacggaggctcaggtagtttaaataaatttgccatgtcacacgcagtggctcatgcctgttataaccaacactttgggatgctgaggcaggaggattgcttgaggccaggagttggagcccactctggggaaaacatgttgagatcttgcctctgcaaaaataaagtaaaataaaatttaaaaaaagtaaaaaaataaaatcagctgagcatggtgacatgcacctgtggtaccagctactttggaggctaagttgagaggcagtgatgggaggatcatttgacggcccagaggttgaggctgcggtgagctgtgtttgtgtcattgcactccagcctgggtaacagagtaaaaccttctgtcaaaaaaaaaaaaaaaaaaaaaaaaaaaaagaaaaaaaaaaaaaaa

SEQ ID NO: 88 - DNA, 2540 bp, Homo sapiens
gggatgggggcggagtccagggcgtgggggggccggtttgttgtggtcgccattttgctggttgcattactgggtaatcggggccctggcttgccgcgtccgccggataccctcagccagtgggcaggtctgagctcgggctccccgagcagtttgagtccccttgcccgctccttcaggtctcagcggcggtggcagccgaggtgcaggatgcaagaaggcgccccccggccgggctcccgctccaggcctcgctcccctgcggccctctgagcccaccatggccgtcccaccgggccatggtcccttctctggcttcccagggccccaggagcacacgcaggtattgcctgatgtgcggctactgcctcggaggctgcccctggccttccgggatgcaacctcagccccgctgcgtaagctctctgtggacctcatcaagacctacaagcacatcaatgaggtatactatgcgaagaagaagcggcgggcccagcaggcgccaccccaggattcgagcaacaagaaggagaagaaggtcctgaaccatggttatgatgacgacaaccatgactacatcgtgcgcagtggcgagcgctggctggagcgctacgaaattgactcgctcattggcaaaggctcctttggccaggtggtgaaagcctatgatcatcagacccaggagcttgtggccatcaagatcatcaagaacaaaaaggctttcctgaaccaggcccagattgagctgcggctgctggagctgatgaaccagcatgacacggagatgaagtactatatagtacacctgaagcggcacttcatgttccggaaccacctgtgcctggtatttgagctgctgtcctacaacctgtacgacctcctgcgcaacacccacttccgcggcgtctcgctgaacctgacccggaagctggcgcagcagctctgcacggcactgctctttctggccacgcctgagctcagcatcattcactgcgacctcaagcccgaaaacatcttgctgtgcaaccccaagcgcagcgccatcaagattgtggacttcggcagctcctgccagcttggccagaggatctaccagtatatccagagccgcttctaccgctcacctgaggtgctcctgggcacaccctacgacctggccattgacatgtggtccctgggctgcatccttgtggagatgcacaccggagagcccctcttcagtggctccaatgaggtcgaccagatgaaccgcattgtggaggtgctgggcatcccaccggccgccatgctggaccaggcgcccaaggctcgcaagtactttgaacggctgcctgggggtggctggaccctacgaaggacgaaagaactcaggaaggattaccagggccccgggacacggcggctgcaggaggtgctgggcgtgcagacgggcgggcccgggggccggcgggcgggggagccgggccacagccccgccgactacctccgcttccaggacctggtgctgcgcatgctggagtatgagcccgccgcccgcatcagccccctgggggctctgcagcacggcttcttccgccgcacggccgacgaggccaccaacacgggcccggcaggcagcagtgcctccacctcgcccgcgcccctcgacacctgcccctcttccagcaccgccagctccatctccagttctggaggctccagtggctcctccagtgacaaccggacctaccgctacagcaaccgatattgtgggggccctgggccccctatcacagactgtgagatgaacagcccccaggtcccaccctcccagccgctgcggccctgggcagggggtgatgtgccccacaagacacatcaagcccctgcctctgcctcgtcactgcctgggaccggggcccagttacccccccagccccgataccttggtcgtcccccatcaccaacctcaccaccacccccggagctgatggatgtgagcctggtgggcggccctgctgactgctccccacctcacccagcgcctgccccccagcacccggctgcctcagccctccggactcggatgactggaggtcgtccacccctcccgcctcctgatgaccctgccactctggggcctcacctgggcctccgtggtgtaccccagagcacagcagccagctcgtgaccctgccccctccctggggcccctcctgaagccataccctcccccatctgggggccctgggctcccatcctcatctctctccttgactggaattgctgctacccagctggggtgggtgaggcctgcactgattggggcctggggcaggggggtcaaggagagggttttggccgctccctccccactaaggactggacccttgggcccctctccccctttttttctatttattgtaccaaagacagtggtggtccggtggagggaagaccccccctcaccccaggaccctaggagggggtgggggcaggtagggggagatggccttgctcctcctcgctgtacccccagtaaagagctttctcacaaaaaa

SEQ ID NO: 89 - DNA, 522 bp, Homo sapiens
tctggatagctttattgaagtgtcgtgtacaaagcatacatttcatgcacttaaaatgattaaaatgatgtttagtatattcgcagagttacaaccatcaccactactgaaatttagaaagttttcatcacaacacaaagtaacgttctatcagttagtggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaagcttatgcttac

SEQ ID NO: 90 - DNA, 1485 bp, Homo sapiens
ctcccactcccacaccacccttacctcccaccccgatctccccctcactccacccaccaccgccaccaccccacacaccgacaccccacaccaccctcccaccacccagcctcctctctccatccaacaacacacacctcacacccagttaactagacatatagttgtcgccagtggtgtttttacccgaaggaccgagcgcagcgcagcctgtgtaagcgaggaagcggccgcataacttcgctatagcatacattatacgaaggttatcagtcgacggtaccggacatatgccctgtggaacttcggccattacggccggggttgtttctgagaaacagttctctaaaaggtatttgaaataccttaccaatgaaataccttaagaagaacaatcttcgtgattgggcttcgagtggttgcatctgacaaggagacctacgaacttcgttacttccagattagtcaagatgacagatgaatcagagctcggaggcaactaggccacggcctccccttacagggcctaagcctcactcacctccacctaaatgaagtataccattgagaaataccaagaaattggctctcaagtctcatcagctgaactacaccacctactcatactccttcaaacaccacccacacccacccacacccacacacccacaaccaccgtgtggcgccgacgacctctcggccccccgacaacacatcttcttaaatcaaaacaatctctcctttcgacgccacccctcgtgtctccactaaaacatcatacaccatttacacacatcttgacaccctatcctattattattaccttctacagaacaaacaccatttgcacactaattcacccaattccattacaaattatccatacacaccacgatctataagcaatcaggtcgctccgcgcgggatgttcataccctgtagtactagttaccatagtgacacagacgagctcaccactctctccagacatcgtcagagacagagcctccaaacaacggggggagctatcattctacaacagcagtatttagttacataaaagccaagacctccgacaactataacacatatataccccgacaactaactatcactttagaaaacaacgcatctaaaaacacatccctatactctaaccaatacataatatcaattcacaatgaaaatccctatcatctgatcaacgattagagcacatacatctatcctaaccaatatccaaatacaaagaaaaataaccacaacaacaaagtgcggacaagcccccgcacaccaatcagactgagcagtttaggagttcagatggctacactgcaagtagtcgcgaagaagtcacccaggaccatgacgatcacggaggagaaatgcatgagtctttctgcggcgaatcggagtaagggcgattgtctcgttaggtaatacatcatcttcgtgcatactatcgtatttacaagtgagcttagt

SEQ ID NO: 91 - DNA, 5116 bp, Homo sapiens
tgccggggcaaattctgttttttattattgtcttggcatcttgatatctagaccactcctacaagtttatctggcagtaggaacttggtgcatttttttctacgctacacccccccacccttaatctttctttgctgtcataatattcagtagcatttataaaagctgtctagttagctctttaaaaacttttgtcctgcaaaatgtttgttagtcaacacactactttgtgtaaacaactattatgtttccttgggaccatcacaagctctttaacaaacacaaggactcaattcattcagcaggtggggattaaagaatcaaagcccagtagcaaaaccaaaactgaagaacgagcagacatgtgtatgaatcggaacctttagaacatgactgtggtttacttttaggctggaggcacacaagttgctgaacagacttgaattatacatgtgcttccatctttccatgtttccgctcctattttggtagcatcttgagattccttgatgcctccgccatcctcatccctgaggaactgctgataccttgctatggaacctcttctttctttcatgctttttattccgtatcttctgttttggacatacatacatatattctataaaatctctctcagcccaccccctgcattaggatttccatatttaaaatatttgtacactgactggggaagggagagattgcactataaacaagttcagtggatgtttgtagcaatgagtaaaactgtattctaaattaaaaatcaaatatatatacacgcagttatacacacacattttttaaaaggaggaggaggaaagagagctattgtccattcctacattttgaaataaacttgtcaagattacgcatcagtaccagggttgtggaatcatctatggaaatcaagaactagaatctgaactgaatggtcaaagaaacttctatgcctagtgaaaactagaggggagcaactatgtagctatgaacatgaatcaattccataactgttactaaaaacttattttgactaaaaagtcaccaacacagaactattgaacacaaacaggaattgtttgtcttactgaagtcactgagaacccttggggttcacttcagatgcttttttggttcaacttcccaccaccagaaaagggaaaagtgattgatttcgtgtgtgaggtactcatctgtcagaacccttaatgtttcctattaagtgaatgacaacttccatacatacactatttataccaaataattttcactacaaattctgatttccttctcctttggagtaaagtaatagctgttagattgctttcaaacttagaaggtccagatataacaattcatttcataggaagccacttcatcaaccattctatgtgatacatcctgcttctttctacaccgctggagaggcagtttggctggtttcatttggatagaaaaaactatcatttgtgcatgctgccatctagtggtgtacaacacaatctaacctgagtttaatattcactagaatgtgtttgacgaagggaatgaaaacctgtagagttcaaggacctttatgacaaacagatgtagggaaattttcacttcaaatttataattttcttattctcacttttttttcatttgcatcactcatctcaatattaggtcactgtgagcccagtacatcaactcattcatacacaacatatcttcagttgcttcttgtaacagaactatgtaaaatctatataaaacagtctttgaagagttgtcatttttaacacttatggttttcattggggtttgtatactttaaatctccttttagttccttaatatttatctttggaaatgtaagaagtatctgcttagaaagaaataagtcttatatatgcgaatggaatactatgtctagggaagagaaaattggggttgttaatcaaagggaagaaagcagcttcttttctgctgaatttgggaatccaaaggcagaggtttcatcctgtttttattttcttcttatcacactctttcaagtttccttaatgtatctggaaggaatagaagttggattcagaattgataactggcatggtgatgacaaacctgtgtaacaccaaggttctcacagctaacagctgtttcacaaacggcatcttccaaatgaacagtcacctctgctatgcagaaaacccccatcctgctgtgagcaagttaggctcttcaagaactggacaacttttgggtgaggtgttcaatatcaaactgcataatcattagccattttcatatatactattttatagatttaagtctctcaactatcaaaaagtagagcgattttcaggagaaaaaagtcgtggggactgagttcaggacaccctgaaactatgcgaccagtaatttttttaaggtattttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaatccacgtatgcagaagggagttaataaggtgatcaccatctccccagaattcaaaggtctttgcctctataaggtctgcccctatggggccaggaaaatataaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcataagtcatggttcctaggttttcctgtcacctcattgtattcatctgtggtaggatattaacgggctcattcaaccaaatgtaatgtgtgcctcagacctatttagcatggttggggggcatcagcaggacaaaccaacaggtactccgcaagtgtactggcacagcaagcccaccaattattagcagctcttcatcagcctgctgtctactcagacgcttgcctactgaagggacctgtccagagatcttctggaatcccaggttgggaatctctgcagaatgtcgtgacagttgtggcccaactagcttctgagtagaaacaaggaagctaccctgagatatagtcagctgcccacctgccatagtatttgctactgaatgccagccttttaacataccatttcagatttgtccttcaacaaaaatataaattgcaagtcataccatttaagggtcttttacaaatatgtctaaattgtgtgtcatttttaagttccaaaggtctactggactaagtactatcagaccagctgtagaacctgatggcgctgatccggggtggaataaccctcagtactggtgtgtagaagatgaattgtaggcaggttttgctgatcagcagcctaaggattgatgggctctcttttggcctctgatcctgagcactatggaggcagcatcagagaatggggacctgagctacataggttctcaatgttaaaacaactctgttcggagtgacatataagagcaagaaatctacagctggtgtaaaatacctttgccttttctatcccgaaagtaacaaatggcatctgtacatgtaggggtaaaaactcagatgtctactcctccaggccatggacaagaaaaagtacagcagtcagaacagtggaacaagtgatttgcattctcttcttcacgctttcctagatctgccattggtagcgcagccctcgccctccagacataatgcatcgagcccagttgcagggaacatcactgtgtgtgtgtgatgtcatggtgttatatgtgttgagtttaatgttgagctgaagcaagttggtgaccttcctctttgctctttgtaaagaagacaccaatgtttgtcagagaaaaatccccagcagtcgtgttgaagaggcagtgtcatccacctactttcccctttggaacagttcaactgcagaaaggtcggattgaggttttgtgctttgtcgtttttcttttttaaacaaaacatgacaaccttggcttttccgatatggaacacttttgttgttgtggagttccctcttgctgtatcttctatgcaattccttttctaaaaaaaccccccggcagaggcagagtgccctccggatatctgtccggcgccttgctgagtggtggaggtgagggataccagctccgggtgtgcctcttttctctccctggctgccaatcctgattttccctgcagtccccttggtttgtaaattgcctgcatttattctgtcagccaacatgtacaaaatgtaagaaagaatttttaaacaggtaataaattatatttataagcaaaaaaaaaaaaaaaaaaa

SEQ ID NO: 92 - DNA, 975 bp, Homo sapiens
tcctcaagactagaaagcatgaagcaggggaggcgttttgaaagcttaaggacaaaagaccatgggcctggatggctgattccgggatcggcatcgtaatttgttgagaaggaggccgtgctgtgctgccagttattaatgggtttaatcggttgatacacagccctactggcctaaccagtagcccagggcccgagaggatttgcaggtcgtgtcagaatttgattgaagttccttccacttggcataaggagacaccatcagcctgattgagagggtcatggtgagatggagcccgccaaggtggcagcgctgagctgaccacgccacggaccatagagtgggagcctttcctgcccccttaaccgcagctaacatcaaaagcactggtatgggctgtctaactggaacctgagttggtctttgtaattacgattcttttgggtttattttgccagttcattatccacccccctgaaatcaggcctcccaaatttagcaggtgctggggaggaccccagggagtggcttgtgggggctagctggtgaaactaccctttcctttctgttctatgagtgtgatggtgtttgagaaatatggggctatggttcaggcgcacttcacatgtgcaaagatggagaaagcactcacctgcacatttaggctcagaatattgattgaaacattttgaaatatcaaaaataaaatgttatttttaaagtttctctgagatttcgcttaagttttggtagatattcttaaattttagtgacctcagtttgggaattcagtaagccaaatattgtatccttattattagttatatagaactatgccttagactttgttagaaacttctgcttcagcttgactgactcattttccatttctggttgtacaaaatgaactgacactttaatgctgtggccacctttaaataaagtacaatgtgacaaaaaaaaaaaaaaaaaaaa

SEQ ID NO: 93 - DNA, 2960 bp, Homo sapiens
tttccaaggaaggaaaggcacacaatggtatcaaatgttcattcattccatctcttgatgctctacgatattatcagtctacactatgctttcctgaaaggccagaagttcaaagatggactagtttcccagggacctgattccccagttggaatactccagccccttggaaattcccgggatttataaaataactctagacaacaagactttgtctttaaaggtcctatgaattcttttctctctgtatttaggtatcctgatttttcttttccatattttccacaggattattttacaaatgcaaatagagagttgaaaaaagatgctcagcaagattaccatctagaatatgccatggaaaatagcacacacacaataattgaatttaccagagagctgcatacatgtgacataaatgacaagagtataacggatagcactgtgagagtgatctgggcctaccaccatgaagatgcaggagaagctggtcccaagtaccatgactccaataggggcaccaagagtttgcggttattgaatcctgagaaaactagtgtgctatctacagccttaccatactttgatctggtaaatcaggacgtccccatcccaaacaaagatacaacatattggtgccaaatgtttaagattcctgtgttccaagaaaagcatcatgtaataaaggttgagccagtgatacagagaggccatgagagtctggtgcaccacatcctgctctatcagtgcagcaacaactttaacgacagcgttctggagtccggccacgagtgctatcaccccaacatgcccgatgcattcctcacctgtgaaactgtgatttttgcctgggctattggtggagagggcttttcttatccacctcatgttggattatcccttggcactccattagatccgcattatgtgctcctagaagtccattatgataatcccacttatgaggaaggcttaatagataattctggactgaggttattttacacaatggatataaggaaatatgatgctggggtgattgaggctggcctctgggtgagcctcttccataccatccctccagggatgcctgagttccagtctgagggtcactgcactttggagtgcctggaagaggctctggaagccgaaaagccaagtggaattcatgtgtttgctgttcttctccatgctcacctggctggcagaggcatcaggctgcgtcattttcgaaaagggaaggaaatgaaattacttgcctatgatgatgattttgacttcaatttccaggagtttcagtatctaaaggaagaacaaacaatcttaccaggagataacctaattactgagtgtcgctacaacacgaaagatagagctgagatgacttggggaggactaagcaccaggagtgaaatgtgtctctcataccttctttattacccaagaattaatcttactcgatgtgcaagtattccagacattatggaacaacttcagttcattggggttaaggagatctacagaccagtcacgacctggcctttcattatcaaaagtctcaagcaatataaaaacctttctttcatggatgctatgaataagtttaaatggactaaaaaggaaggtctctccttcaacaagctggtcctcagcctgccagtgaatgtgagatgttccaagacagacaatgctgagtggtcgattcaaggaatgacagcattacctccagatatagaaagaccctataaagcagaacctttggtgtgtggcacgtcttcttcctcttccctgcacagagatttctccatcaacttgcttgtttgccttctgctactcagctgcacgctgagcaccaagagcttgtgatcaaaattctgttggacttgacaatgttttctatgatctgaacctgtcatttgaagtacaggttaaagactgtgtccactttgggcatgaagagtgtggagacttttcttccccattttccctccctcctttttcctttccatgttacatgagagacatcaatcaggttctcttctctttcttagaaatatctgatgttatatatacatggtcaataaaataaaactggcctgacttaagataaccattttaaaaaattgggctgtcatgtgggaataaaagaattctttctttcctactacattctgttttatttaaatactcattgttgctatttcactttttgacttgacttttatatttctttaaaaaattccttccttttaaaaaatataaaagggactactgttcattccagttttcttcttctttgttgttcttctagtgtgacttttcaagtgtaacagccattcttcctgactttaatattgtccagttctggtcttttctgtgaattaccactgggccccttacctcaatgctttttgttgatgcccactctggttcccttgtttatctgagtctgttggtaccccaaatgaccccacacccatyttaaagtactttttttcaccttccctgtttagtactggccagatgagttttttctagagctctgtcactatctgaaaagaaagaggctatgggaaacatagaaatggtatgtattaataactgatcataggctgaggagaaaaaatgtagctggctgcaaacccagtgctgtgaggtgacttatatgaggttccagatcaaagacaggccgtgtgagccagtccaggagggtgtaagttctgaatggttccttgctgactttgggtgacacatgtaccacatactggctcagtttaagtcatggttctattgtagatttatttttatattagttaataaatgactttaaattgtcaccaattgaaaatcttgtcactcttttggttttctttatatagctcagccaaatctctgttttatgtcctgtcctcatctcttaagctaaatctgtttggatcatattaataaacctcgtgccg

SEQ ID NO: 94 - DNA, 969 bp, Homo sapiens
tgttatagaccaagtggtaaaaaagcaggctggtacggtcggaattcccgggatatcgtcgacccacgcgtcggaaatacacatttggagctgagtgggagccaaactatgagctttattgaggtgaagctatactggaaaagcttgccctgtagctccaagtggactgtcccatcctctttctagaccttgaggcttacctcaggaggatgatgtttaaatcaacagctgaaagacttgtgagtggtttctacaccatgttaaagagaaggttctaagacagcatgataggcctctaggcctggcctggactctggctcagtgttgcttaccatatgtagaggatgaacagaggttaagcccatcaaggtctgaagtagagcccaggaggaactgaactgtatctggctttcaggatccttttcccagtgtcatcaatcagagaagtcaaacctctgtgagaatgcttgtgcagaggtataagagtctcatgtattggttggcttttgctgcacctttctcattctgttggagggacattggttagtcaggactctgaaggccagctttttcacactgaccaaagcaagtgaaggtcaagcctaactttaatgggaccaggaagtatactcctcccatggaggtggtgggaatggcaccgagaagtttgatgacagttatctaatggactagaggtggcaaactttctgtaaatggccaggttagtaaaatagtccgcttttgaagggatatggtctcttgcacctactcgaggtgaaagccggtatagacaatacttaattggaatgaggtgaagggtgtcccataagaaaacaacatggtggggttcgggccaggttgtgctaccgtcctggacgaccagtgccttggccaatatgaccctctattggcttgacggaatagccagaacaggggccccagttccgaggtcatcattctggggcgttt

SEQ ID NO: 95 - DNA, 352 bp, Homo sapiens
ggttgttaagtctcccatgtttagtaattaacagaccccgccagagaggaacagaacaaaaatgagcatgcaaatgactaatcaaggaaagctggaatcaacaagatatgggtaaaaagatgctcctctgagcctggccatcatgcggcaggttctgcgcctctgatcacactgagctgcccaccttcccatgccctggaggtaaagctatgtagtcctaccctggtagcataggctgtgcactacacaattcagcatttgacttgaacaagaatgggatactttggatacttttttctttaaaatggttccagtctcccaaacacaagtatggttgtatgatgcattttag

SEQ ID NO: 96 - DNA, 2828 bp, Homo sapiens
agcagccggcacggggacagccggccgcacaacggatctgcaggcgcggagcaaaatgcacccgccgcgccgcgcggtcctgcagccccgccacggccccgcggcccgcacccccccggggcgacagtgagcctctcccgccaccaccgggggccgagcggagggctctcgggtgggagagcgggaccagatctcgacagctgttcatttccaggaagccaccgcagccagagcgaaaggggaccttctgccaccagcggggcatcagccagcggcgcgcatggatttatgaagacactcatgcaagaagtgggcaggacttggacaaacttttccaccggctccgcgtccgccgctccccgcgcctcgtctcctttcccctcctctcccggcggccgccgctgcccgcgatggtggccgcgctgctgggcggcggcggcgaggcccgcggggggacagtgccgggcgcctggctgtgcctgatggcgctgctgcagctgctgggctcggcgccgcggggatcggggctggcgcacggccgccgcctcatctgctggcaggcgctgctgcagtgccagggggagccggagtgcagctacgcctacaaccagtacgccgaggcgtgcgcgccggtgctggcgcagcacggcgggggcgacgcgcccggggccgccgccgccgctttcccggcctcggccgcctctttctcgtcgcgctggcgctgcccgagtcactgcatctcggccctcattcagctcaaccacacgcgccgcgggcccgccctggaggactgtgactgcgcgcaggacgagaactgcaagtccaccaagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggtggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgcggggacctgccctatgggcctgggcgcaggagcagcggcggcggcggccgcttggcgccccggggcgcctggaccccactcgcctccatcttgctgctgctgcttgggccgctcttttagccctcgcgccccccgccgttggctgcgggagagcccgcgtcccactcccgtgctcgcctcgaccccgcgccgggcacctgtggcttgggacagatagaagggatggttggggatacttcccaaaactttttccaagtcaacttggtgtagccggttccccggccacgactctgggcacttcccctgaagctcctctccggagcttgacttcttggacctcctcccccgccccaattccaagctccagaaactcccaactcgtctgccgtccagaaagctagctgcagtgttcaggacgtccgggaggaagcaagcatgtgggggacagaacagtagtcctggactcgaaagggaaggtgctgaccagtggggccttagcaatttgaagggttgggaaggaggaattatatttgcaaaggggctgtctattagcatatttcctttgagggggcaaaaaaaagtgccagtatcgacttttacagattgtggccagtgaggatattataatcctatgtaaacagaaaagtcccacttaccgattcattctttcactgtttgtatctgcgcccagaattctcagtgacgtgggggtgagggtgggtggcgattgccttagagggaacccctaaattggttttggataagtttgagcccttgaccttaatttcattgctaccactctgatctcttagcacatttcttaggattaagggtccaaaaatgctgatctaaggggttgccatggtgttgaacaatgcaactttttatttaaaaaagctctgcactgccatgtatgaaagtctctttatgatgtttgtttttttgtcatttttgttctttacatcaagaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgtttttttaaaaatcctaagtttttaaataactatggatttgtgtattttttttggttatttgttttattaaaacatgtacatcagtaaagagttttaaacaatga

SEQ ID NO: 97 - DNA, 2831 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactag

SEQ ID NO: 98 - DNA, 750 bp, Homo sapiens
attgcttcatggacacaggaagacttctccaaaaaaagcaactttcttcttattgttatccttggcaaaattaaatcatgtcgtaaacaatatcccaatcctcttgtcatccatcagactctagaagggtggctcctaatgcttttcgggtctcggaccactgtggaaatttggtgaaagccatgcaactcctcctttggaaaagttatggtagcctgctttagaatataaatgcagaagttcagggtatagtgaactccatcagtggaaccctagaaagtctcaagctttagcaggagtggctgggctggccaagggaaggaacagggaagaaggactggttggatttacaggtctcacggagagtggtggcattgtcacagaaagattatggactccctgccttctaagcacaattttattttatctccattaaaatattaactcttttggaaacatgaactcttactgccttaaaaaaagcaatctagcaacaagtgttaaaacctgaaagacacaaatacgttttgttctggcaattccactcctgggaatctctcccatggaaacaaaattatcagcatagaaagcgtaagtacaaggatgtctatgacagcaccgtttgtagtagcacaaaactggaaacagagcgaaaggtcatctgcaagagaatagtgagttacattttgataatctgcaccaaagaatatgatgcgatcatttaaaggaaggaaatagagctctatagcc

SEQ ID NO: 99 - DNA, 4322 bp, Homo sapiens
cccccagaggcgccggagcccggaatcccgctcggagccagccagccgtcccgagctaccagcaggtttcattgaaaacagatcctgcaaaagttccaggtgcccacactggaaacttggagatcctgcttcccagaccacagctgtggggaacttggggtggagcagagaagtttctgtattcagctgcccaggcagaggagaatggggtctccacagcctgaagaatgaagacacgacagaataaagactcgatgtcaatgaggagtggacggaagaaagaggcccctgggccccgggaagaactgagatcgaggggccgggcctcccctggaggggtcagcacgtccagcagtgatggcaaagctgagaagtccaggcagacagccaagaaggcccgagtagaggaagcctccaccccaaaggtcaacaagcagggtcggagtgaggagatctcagagagtgaaagtgaggagaccaatgcaccaaaaaagaccaaaactgaggaactccctcggccacagtctccctccgatctggatagcttggacgggcggagccttaatgatgatggcagcagcgaccctagggatatcgaccaggacaaccgaagcacgtcccccagtatctacagccctggaagtgtggagaatgactctgactcatcttctggcctgtcccagggcccagcccgcccctaccacccacctccactctttcctccttcccctcaaccgccagacagcacccctcgacagccagaggctagctttgaaccccatccttctgtgacacccactggatatcatgctcccatggagccccccacatctcgaatgttccaggctcctcctggggcccctccccctcacccacagctctatcccgggggcactggtggagttttgtctggacccccaatgggtcccaaggggggaggggctgcctcatcagtggggggccctaatgggggtaagcagcaccccccacccactactcccatttcagtatcaagctctggggctagtggtgctcccccaacaaagccgcctaccactccagtgggtggtgggaacctaccttctgctccaccaccagccaacttcccccatgtgacaccgaacctgcctcccccacctgccctgagacccctcaacaatgcatcagcctctccccctggcctgggggcccaaccactacctggtcatctgccctctccccacgccatgggacagggtatcggtggacttcctcctggcccagagaagggcccaactctggctccttcaccccactctctgcctcctgcttcctcttctgctccagcgccccccatgaggtttccttattcatcctctagtagtagctctgcagcagcctcctcttccagttcttcctcctcttcctctgcctcccccttcccagcttcccaggcattgcccagctacccccactctttccctcccccaacaagcctctctgtctccaatcagccccccaagtatactcagccttctctcccatcccaggctgtgtggagccagggtcccccaccacctcctccctatggccgcctcttagccaacagcaatgcccatccaggccccttccctccctctactggggcccagtccaccgcccacccaccagtctcaacacatcaccatcaccaccagcaacagcaacagcagcagcagcagcagcagcagcagcagcatcacggaaactctgggccccctcctcctggagcatttccccacccactggagggcggtagctcccaccacgcacacccttacgccatgtctccctccctggggtctctgaggccctacccaccagggccagcacacctgcccccacctcacagccaggtgtcctacagccaagcaggccccaatggccctccagtctcttcctcttccaactcttcctcttccacttctcaagggtcctacccatgttcacacccctccccttcccagggccctcaaggggcgccctaccctttcccaccggtgcctacggtcaccacctcttcggctaccctttccacggtcattgccaccgtggcttcctcgccagcaggctacaaaacggcctccccacctgggcccccaccgtacggaaagagagccccgtccccgggggcctacaagacagccaccccacccggatacaaacccgggtcgcctccctccttccgaacggggaccccaccgggctatcgaggaacctcgccacctgcaggcccagggaccttcaagccgggctcgcccaccgtgggacctgggcccctgccacctgcggggccctcaggcctgccatcgctgccaccaccacctgcggcccctgcctcagggccgcccctgagcgccacgcagatcaaacaggagccggctgaggagtatgagacccccgagagcccggtgcccccagcccgcagcccctcgccccctcccaaggtggtagatgtacccagccatgccagtcagtctgccaggttcaacaaacacctggatcgcggcttcaactcgtgcgcgcgcagcgacctgtacttcgtgccactggagggctccaagctggccaagaagcgggccgacctggtggagaaggtgcggcgcgaggccgagcagcgcgcgcgcgaagaaaaggagcgcgagcgcgagcgggaacgcgagaaagagcgcgagcgcgagaaggagcgcgagcttgaacgcagcgtgaagttggctcaggagggccgtgctccggtggaatgcccatctctgggcccagtgccccatcgccctccatttgaaccgggcagtgcggtggctacagtgcccccctacctgggtcctgacactccagccttgcgcactctcagtgaatatgcccggcctcatgtcatgtctcctggcaatcgcaaccatccattctacgtgcccctgggggcagtggacccggggctcctgggttacaatgtcccggccctgtacagcagtgatccagctgcccgggagagggaacgggaagcccgtgaacgagacctccgtgaccgcctcaagcctggctttgaggtgaagcctagtgagctggaacccctacatggggtccctgggccgggcttggatccctttccccgacatgggggcctggctctgcagcctggcccacctggcctgcaccctttcccctttcatccgagcctggggcccctggagcgagaacgtctagcgctggcagctgggccagccctgcggcctgacatgtcctatgctgagcggctggcagctgagaggcagcacgcagaaagggtggcggccctgggcaatgacccactggcccggctgcagatgctcaatgtgactccccatcaccaccagcactcccacatccactcgcacctgcacctgcaccagcaagatgctatccatgcagcctctgcctcggtgcaccctctcattgaccccctggcctcagggtctcaccttacccggatcccctacccagctggaactctccctaaccccctgcttcctcaccctctgcacgagaacgaagttcttcgtcaccagctctttgctgccccttaccgggacctgccggcctccctttctgccccgatgtcagcagctcatcagctgcaggccatgcacgcacagtcagctgagctgcagcgcttggcgctggaacagcagcagtggctgcatgcccatcacccgctgcacagtgtgccgctgcctgcccaggaggactactacagtcacctgaagaaggaaagcgacaagccactgtagaacctgcgatcaagagagcaccatggctcctacattggaccttggagcacccccaccctccccccaccgtgcccttggcctgccacccagagccaagagggtgctgctcagttgcagggcctccgcagctggacagagagtgggggagggagggacagacagaaggccaaggcccgatgtggtgtgcagaggtggggaggtggcgaggatggggacagaaagcgcacagaatcttggaccaggtctctcttccttgtcccccctgcttttctcctcccccatgcccaacccctgtggccgccgcccctcccctgccccgttggtgtgattatttcatctgttagatgtggctgttttgcgtagcatcgtgtgccacccctgcccctccccgatccctgtgtgcgcgccccctctgcaatgtatgccccttgccccttccccacactaataatttatatatataaatatctatatgacgctcttaaaaaaacatcccaaccaaaaccaaccaaacaaaaacatcctcacaactccccagga

SEQ ID NO: 100 - DNA, 413 bp, Homo sapiens
ttaatttagacttcctacgtgtaactaaaatctctaaaacaaggtggcttattttacatatctgaagaaagtgaggcatgcaattttcccttcctcatagtccgacctaagagtgtgtggcaaactttgtagaattctaagtttccttcaagaacttttcatcttatttccatccacaaattaaaagggatggaattactcaatgtagccatagctaggaatacagtttagtgaagaacaggaagggagagagacagaaggactcctacagtttttctttacaatctaaatatgttaaatgcatgatggaagcaatggagccaggtcaaaatggcacttgctgtgttgtgaaaaatcctgactatgagaatcttctgtagtagaaaggcaggtcattctatcacaccaactgg

SEQ ID NO: 101 - DNA, 1510 bp, Homo sapiens
  misc_feature (125)..(125): n is a, c, g, or t
  misc_feature (127)..(127): n is a, c, g, or t
  misc_feature (139)..(139): n is a, c, g, or t
  misc_feature (229)..(229): n is a, c, g, or t
gcgagcgccgggaacgagcaccaccagggcttggcagcggacggctttagaagagcctagctgctgcgcgcgtcggagaggctcctgggaaactcccacggcccagggactttcgaaagcagagngnggagccctcgancgcgctagtctgcgagtgagcgctcagcccggcacctgttcctccagcgccgccgccttcccacccctcggacccgcgccgctcgcgcgncgcccgttcctgcgatgaatccggccctaggcaaccagacggacgtggcgggcctgttcctggccaacagcagcgaggcgctggagcgagccgtgcgctgctgcacccaggcgtccgtggtgaccgacgacggcttcgcggagggaggcccggacgagcgtagcctgtacataatgcgcgtggtgcagatcgcggtcatgtgcgtgctctcactcaccgtggtcttcggcatcttcttcctcggctgcaatctgctcatcaagtccgagggcatgatcaacttcctcgtgaaggaccggaggccgtctaaggaggtggaggcggtggtcgtggggccctactgacccgccctctgcccccgcggcaaccgctcccacgcctgcccactttgctagcccggctgtgcccctcactatcagagactgggcgaagcaaacctgtcggagtcaattatttctctcgacttcggcctttcggaaagaagcgaccggtttctccctcgccctctgaaagtcctcatgcctggcagtcggaggagagcgcccagactctgaactcagcagaaagtggcaagaagagggcgattagggcgcagaactttggaagctgctacttacttggaatgcggggagaccgacggtgcgaaggcccttgttctcacccgcaggtgggccaagctctgggggcaggtggagagggcgggcaggggagagacccagcggcactgatcgccttgtgaccggaagagtgacctgttaaaagccacgcagcagactcatggggtctcacaaatccgtgtccgggtgcgctcccactcttctcctgctccccccctgccctggaggggaggggcgataaatacctttgattgtaacgtgccgttttaagaggttttgtgtttgtttgcttgaatacaaatgtttgataagtctttttctgccccagtggcctgtttgcctgcctgaggagttacagttttgtcattgtgggaagaaggggtggggggagggggagcctgcgaatttgaacggggtgagttgtttcttttagtgcatttcccactgggtcttttgggaggcgtctagcgttcctgctggccctgggacaaagacccagaatagaactcgtagctcgtgactgcacggtttacgccacaaaagtgctcttgacatccgtgacaccgttttgactttttgtttttttcttatttaacatttccttaataaatgcaacatttaagcgttaaaaaaaaaaaaaaaaaaaaaaaaaaaaaaaaaaaaa

SEQ ID NO: 102 - DNA, 5482 bp, Homo sapiens
cgggcagcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggttcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 103 - DNA, 8034 bp, Homo sapiens
cttgagtgttagagctgagtagttttcccagaatctctaagtcctttttatgctcttttatgaatgaatagaattagtaaaagataaataaattttttcttttggatttcttaaccagtggaaaaaatgttgactttaaaagttcataaaatcaaattttgcttaagaatatgttatttccacttgtgaggccagcctggtagacctctgggatccttttctgttcactcacacaccactgagataaggagtgaagtgtgggctaaatagggctgaggcttgggcaagggcatttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaattcgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgggcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacgcctggtgctgctaattgtgttcatggtttcctttgattggctattgaacccttctgggaaatgtatttttgtagactttaatagagaagttgattgtcccttaaatgtagcgtgtgtttgaaacttcttagctgtcactttggaatcaccccaagccaattctcttaactctgtaatgcagccaataatacaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagtttggaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtgtcttcttttggaaaatggtattcaaattctggaatggaaatctagccaccaaaacgggttaatcaaaagacgtccttttccgttttttttgcttttattttctaaatcatttttaagggaatgaaacaggaatgtcatcagagattttttagtacaggcccaagagcctgtactctaagaaagaaatttttgccatgtatgaattttcgaataagtgactttgcaggcttttgctagcccttgctggtgggtctggaaattacatccagagtctgcagtccaggtcaccaagccagcggcacccgtcggcaaccctgtgtttaacggattgtgccgtttactgtgacctgcaacggggtggcattcacttagggtctgacttcacagctatgacaaaaccgaaaaagcaaaactgcgaggaagtgctaagatgtacgggtcttggggatatctgccttatatgttatattcaaggaaattaacgaaacatcctgtgaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggtttctctcactgaaatggccagtcgtgattaaagtgataaaaccccatatctgttttggtatattgtacacaaacctacaaaaataaactgaacttgcaatatttttgcaataaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcagatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgcgcttaggccataatttggtagtgttggcagttgttaataaagcttgtcaggatgttaagcatctcaggagaaatattggaaaattatatgtataaaaccaaagtgctgtttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttacaaatgaaggggcttcacggaatgttacaatgttactaatataatttggcttttgttatgcaaattgttaacaccagctattaaaatatattttagtagaaaaaaaaaaa

SEQ ID NO: 104 - DNA, 388 bp, Homo sapiens
  misc_feature (11)..(11): n is a, c, g, or t
  misc_feature (278)..(278): n is a, c, g, or t
  misc_feature (296)..(296): n is a, c, g, or t
  misc_feature (314)..(314): n is a, c, g, or t
  misc_feature (316)..(316): n is a, c, g, or t
  misc_feature (318)..(319): n is a, c, g, or t
  misc_feature (325)..(325): n is a, c, g, or t
  misc_feature (368)..(368): n is a, c, g, or t
ttttttttctnttatgttggaatagagagatgggaaaaagggaaggcagcttcaaaagaaaccaaaactaagtagcttaaactacacgctttgttgagaagcaaatctatttgaccaccttgctcatctttctcaataaatgaatcattctcgcctttctttacctacctctccatccttactataccttacccagggctcacattacctcaggttctgcttgaacttcaggtctgtatgttatggatttaccagggcaaatctagattaatataatngttccctctggagtaaanatgattttgactcaaacnangnnttaagntcgggaatatgtatgttcataaggaggcttttatgatcaaganattaacaagagattcacagg

SEQ ID NO: 105 - DNA, 1096 bp, Homo sapiens
atgatcctaaacaaagctctgctgctgggggccctcgctctgaccaccgtgatgagcccctgtggaggtgaagacattgtggctgaccacgttgcctcttgtggtgtaaacttgtaccagttttacggtccctctggccagtacacccatgaatttgatggagatgagcagttctacgtggacctggagaggaaggagactgcctggcggtggcctgagttcagcaaatttggaggttttgacccgcagggtgcactgagaaacatggctgtggcaaaacacaacttgaacatcatgattaaacgctacaactctaccgctgctaccaatgaggttcctgaggtcacagtgttttccaagtctcccgtgacactgggtcagcccaacaccctcatttgtcttgtggacaacatctttcctcctgtggtcaacatcacatggctgagcaatgggcagtcagtcacagaaggtgtttctgagaccagcttcctctccaagagtgatcattccttcttcaagatcagttacctcaccttcctcccttctgctgatgagatttatgactgcaaggtggagcactggggcctggaccagcctcttctgaaacactgggagcctgagattccagcccctatgtcagagctcacagagactgtggtctgtgccctggggttgtctgtgggcctcatgggcattgtggtgggcactgtcttcatcatccaaggcctgcgttcagttggtgcttccagacaccaagggccattgtgaatcccatcctggaagggaaggtgcatcgccatctacaggagcagaagaatggacttgctaaatgacctagcactattctctggcccgatttatcatatcccttttctcctccaaatatttctcctctcaccttttctctgggacttaagctgctatatcccctcagagctcacaaatgcctttacattctttccctgacctcctgattttttttttcttttctcaaatgttacctacaatacatgcctggggtaagccacccggctacctaattcctcagtaacctccatctaaaatctccaaggaagcaataaattccttttatgag

SEQ ID NO: 106 - DNA, 7664 bp, Homo sapiens
gttggatgcatggcaaaagcaaaggtgtggagaaggttcagaggagacaggacatgtataaaatggtagggtcaggttgtcatgggggaaactgaggcacaggaggcaagctgagttagtacaagaacagtctgaatcataacgacatgccagtattacctaaaaggatgaggaacatggagctgtacttgaatccctacgtgagctggggaaaaggggcctcaggaatcactgacattggaaccaaggtttgtctgcagcttgtcggtttctgggacagaaacccaacatactggagtgggtatcccagcaatctgtaggataaaccaggacactgtggtgtcatggatagctggctgtctgccaggtgatggcccctctggttgcaatgtgagccgggcaggtcatccatttggcagcatggtgagggctctggccccagttgctatgggagggaggatgctggcacagggcactgttcacagactgcctttgctccatgccttttccatgagcatgagtggctgttcgtgtgggaaacggcagagccctcgcggtccccatcagcactgtgcagtggtaccggaggtggcaggagacagcctgatggcccaggttgtcttcatacccggcttcatgccagggtgcatgccgggcatagcacatgtgtccctgagaggcccctgatcaggggtggaaacccagcaaagtgaaaatcagaaatagtgattctccagttcctgttcacagataaagaaagaaagaaataataagcaatactaggcctggtgtggtagttcacacctgtaatcccagcactttgggaggccaaggcaggcaatcacttgaggtcaggagttcaagaccagcctggccaacatggtgaaaccccgtctctactaaaaatacaaatattagccgggcatggtggcgggcgcctgtagtcccagctactcaggaggctgaggcagaagaatcgcttgaaccggggaggcggagggtgtggtgagccgggatcgcaccgctgcactccagcctgggtgacagaatgagactccatcccaaaaacaaaacaaaacaaaacaaaaaacaaacaaaaacaactaaaaggacagtatctttttagcacccatcagtgtacaggatgctggggagggtactgtgaacttacccatggtgaaagtccctgtgttaatggataagctcaatgctcagaaaatgctgctgactgtggtattgccccatttaaagagacagtttgcagtacgttttcagaagtggcatgcagcctcagagaaaagtcaccaggggctggcatgattccagaaaatgttacagagcaagtggaatttgacttgaggcttgaaggatgggcaagatttaaataaaattcagaaacggtagagagggaggggctggggggaaggctgcccactggactgtcctgtttgcctccaggagaacctacaggcaagacatggtctcttctcaggtgaatgggaagccaagtagggctggcatgggtgagccacagctcggggaggcaggccccgggccctgcgctgcctgtcatggctcatgagtgatgggagagatctgggcaggcaacctcctctcatcctgcatcatcagcctggacttggaacttggctgctttttctttctgcagttagcagagggccttggccaacacataagcctttctgccagcacttggcattccagctgacctcgacccaaggcctctgtgacttcaggaggcggcagctgggaagggtcagggcagttccaggcagagcacagacgtcagctcagacatcctaccccccgccaaccccccgtccccggggtttccagagcaaccaacaccaccaagctccaggacactggaaaaaaaatctttgcaaagaagcaaggggccatctcagaaaatccaggtcccccaaattgatgtagggagaggagggctttgacagcattcagcactccagagggtcacgaggatacagaaaccatttggagccacctctgcttctcagccccacccaggcaagccctggatcttcaagggactgatttgtacctgggaataaactcatgcatggatgagattcagagtcaatcacaccctaaaatgcagagcccatagtattggtgagttgttcatgtgtctctgaagcaaatttagggctgtggttcaaacatcgtaaaagttaaaaaaaattcactggatacacacagtaggctcttttaaattagcctcatttgaacttaattacatatttaaatactcaaataataaatgatggctgggtgcggtgtctcatgcctgtaatcccagcactttgggaggctgaggcaggctgatcacttgaggtcaggagttcgagcccagcctggccaacatggtgaaaccccgtctctactaaaaatacaaaaattagccatgcatggtggcgggtgcctgtaatcccagctacttgggaggctgaggcagcagaagcacttgaacccaggaggcagtggttgcaatgagccgagatcgcaccactgcattccagcctgggtgacagagcaacactgtgtctcaaaagaaaattttttttaataaaaataaaaaataaaataaaataagtgagtccactgaaagcggtttctaccttgatagttgggtgtgtggcgtcatcaacatcacagaaggctgatcgatattaccaggtgtggttgagtgcaagtgtttgaggtctcgtgggggaagagtttggaattcagaatccattgaggccttcactcaccactttccctctctcgctgtgttcccaaatgtgccacttttctgttggctcacatgcacccatgctctatttgatattcagggctctgaatttcaagccagactcagtcagtgtgattgtcactgctttcctgtccttcctttatcatctgtagacttgggtcccgtttttgcaggttgatgttctgtcttcgctgggctctggactcactgctcacgagtgcggtgtctgcatgggcactgcccagacatgcactgttggtccctcgatggctgcatggtcaggcctcagggctctctgccaggccgacctacagcccatacagacccgatttctgggcctggatccaggggatgccatctgggaagtgcgggatcttcccacgatgtcactgtaaaactcaccagggaggttttagaaattgaaccggcatcattcagattccatcctgctttttggtcctgagaaaatcctgcttttccctgagtaactgggataatgggtcaccagctcccatgccctagatgaggactagttagcattttctagtgcctggagatttccagatggaagctgtacttgggtctgtgtatctttgttacaggattcaataattcatgcactgaatttcccttcccggcaactccagacaccaaatcgcttcccatggtgtcccccaatcacttaggaatttagcctgtgtctaaagaccctctctgcagcctgacgtggctagccatcccagtacttccacgtttttcatgcctttctccaacagcgttgccgtggccccttaggcggcgatcgttttatcaatggtcgctccctctttttatctgttggcaggagccctttttcaacgccctcgctggagtctggcctgcacgccttgctgaatgaagccggaacctcggccccgcttccctttgaaatgaatgttcctggggcgccctctcgtggattttggagctaatcgtctgtgaatgccaagtgatggcaactgccctcccgccacgtctccagccggtgcgggggaacgagaccctgcgggagcattaccagtacgtggggaagttggcgggcaggctgaaggaggcctccgagggcagcacgctcaccaccgtgctcttcttggtcatctgcagcttcatcgtcttggagaacctgatggttttgattgccatctggaaaaacaataaatttcacaaccgcatgtactttttcattggcaacctggctctctgcgacctgctggccggcatcgcttacaaggtcaacattctgatgtctggcaagaagacgttcagcctgtctcccacggtctggttcctcagggagggcagtatgttcgtggcccttggggcgtccacctgcagcttactggccatcgccatcgagcggcacttgacaatgatcaaaatgaggccttacgacgccaacaagaggcaccgcgtcttcctcctgatcgggatgtgctggctcattgccttcacgctgggcgccctgcccattctgggctggaactgcctgcacaatctccctgactgctctaccatcctgcccctctactccaagaagtacattgccttctgcatcagcatcttcacggccatcctggtgaccatcgtgatcctctacgcacgcatctacttcctggtgaagtccagcagccgtaaggtggccaaccacaacaactcggagcggtccatggcactgctgcggaccgtggtgattgtggtgagcgtgttcatcgcctgctggtccccactcttcatcctcttcctcattgatgtggcctgcagggtgcaggcgtgccccatcctcttcaaggctcagtggttcatcgtgttggctgtgctcaactccgccatgaacccggtcatctacacgctggccagcaaggagatgcggcgggccttcttccgtctggtctgcaactgcctggtcaggggacggggggcccgcgcctcacccatccagcctgcgctcgacccaagcagaagtaaatcaagcagcagcaacaatagcagccactctccgaaggtcaaggaagacctgccccacacagccccctcatcctgcatcatggacaagaacgcagcacttcagaatgggatcttctgcaactgatcgtctccatgcgccctgctctgcggctgtgttcttatttattgcatgcgtcgcttccacaggggcccctcaagagctgtgactcgggagagctaccttactttgaccaacagcctgcccagtgtggatgtctcttacagagggggcccaaggaatcaccaccccgcttcagtgtaaacaacgtgccttgtccactttgggctccagagtctttcagatgtactaagctgctgacatcatccactgccttctgctgcatcctagacaccctccctgttgttcacagagagggaaggtcgtgggccacacaatgctgtgtgaccctctccgtgtgcctctgaatggtgttttgatgattttacactacatttcctgtgcgtagaatggatgcttgtatattcgtacatctctatgttacacagaatttgtgttgcaggtgtttgccatgtggtacctacatagaatctccatacaacacacaggtaacaggttatacaagtggattcagactgaacccccagtacaaggacattgttttgaactaggtggacatgccatccctggtctccttagactgacatgattctcatgttaaccaagttttaaaagttcaaattccccaaaaaggcttgtccaaggctggccccagatgtgtgggtctgacccacaccagccctgtgtcctgtcctttcagtcatttgtccctgcgtaattttaatcgtattccaaagcccaattatgtgatggttttcaggtttctgcaaattacagaagagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaacccaaaaaaaaaaaaaaaaaaaaaaaaaaaaaaaaaaaaaaaaaaaaaaaaggaaaaaaaaaaaaaaaaaa

SEQ ID NO: 107 - DNA, 1772 bp, Homo sapiens
agcgctgcaaggacaaccggctggggtccttgcgcgccgcggctcagggaggagcaccgactgcgccgcgtaagtgccgcctgccctgcgtgggtcgtgccagctcagcgggacaggtcctcgcctcggtccctcggacttagggagcgcggggcagaccctgagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagttctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagtgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaaaaaaaaaaaaaaaaaaaaaaaaaaaaaaaaaaaaaa

SEQ ID NO: 108 - DNA, 1907 bp, Homo sapiens
aaaaaagccagcgaccgttctgcctcccgtgggggaggaggagcccaaaagccctgtgctggtggatggggagaaggaattataggagctggagaaacaacatcttctggaagggaagacaagacagtatacaatcccctacagaggagtaccagtgctccggggtcctcgagaccgacttcgccgagctctgcacgcggtggggctacacggacttccccaaagttgtcaaccggccccgcccccacccgcccttcgtcccctccgcctctttgtcggaaaaggccaccttagacgatccgcggctgtcggggtcctgcagcctcaatagcctggagagcaaatacgtgttcttccggcccaccatccaggtggagctggagcaggaggacagcaagtcagtgaaggaaatctacatccgcggttggaaggttgaggaacggattctgggtgtcttctctaaatgtctgcccccgcttacccagctacaggccatcaacttgtggaaggtggggctgaccgataagaccctgaccaccttcatcgagctcctgcctctctgttcatccacgctcagatctcccctgccctcaggaaggtgtctctggaggggaacccactgccggagcagtcctatcacaagctcatggccttggacagcacgattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacggcctccggctgaaccgttccctgctctggctgtccctggcccacaaccgcatccaggacaagggcgccctgaagctggctgaggtcctgcgcgccttcgagctgacacacaccgaagtggtggagcgccgacgcctcctgctggaaaaagggacacaggagcgctcgcgatcgccctcctcctctcgacacggggactccaaaacggaccgtgagaagagtcagatggtagggatcagcaatagtgcattggtggacaagacagacaagacgcagacaatgaaaacccctaagggcctgggcaagaaaaaggagaaatcatgggaattggccaagaaagaggagaagttggggtctgggcagtcacccacacaaggaacccctaagaaggaagatgccacaaaggcaggcaaggggaaggtaaccatccctgaacagaagccaagcagggcaaaagggatcaagatcgggagcagagagaagcgcagcatcctcctggagtccgagcagctggttgttgaggctactgaggtggtcaaccctctcctggagcctgtggagcaccgagatgggaaagttttcatgcctgggaacaaggtccttttgcacctcaacctcatccggaaccgcatcacagaggtggggctggagggcttcctcgccacggtgcagtatcagatgcagttctccaaggccaagagtgcatccaagggtccagtggggctgctgtggctgtccctggctgtgagtccctttcactctctcctgctgaagcagacgttgcccctatcagctgtcatactagacagctgctgcaggcagcttctgtctccccatttccaaggaagaaaaattgcttcgccccacaatgtcctgcgtacgccataatccaggagctgatgttgccaagggatcccatcaaggccaaactcagggaggatgaggccatggcattcttcccctagccccctcccacctgcttgcctctaagactcggggctacagaagcacctcctgtccctgtgtggggtgacctccctgggggagatctcagaccaataacaaagtctgttgctatactttt

SEQ ID NO: 109 - DNA, 3723 bp, Homo sapiens
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttgttgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggcggtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggaggtgtaatggaatcggaatcaagccactcggcaggcatggagctataactaagcatccttagggttctgcctctccaggcattagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctcccaggaagaaagaatgttactgccttaataaaaaatgaaaagagaatgatgctcaaaatctttccaaataaaatgttccctat

SEQ ID NO: 110 - DNA, 485 bp, Homo sapiens
  misc_feature (3)..(3): n is a, c, g, or t
  misc_feature (5)..(5): n is a, c, g, or t
  misc_feature (7)..(7): n is a, c, g, or t
  misc_feature (245)..(245): n is a, c, g, or t
  misc_feature (250)..(250): n is a, c, g, or t
  misc_feature (325)..(325): n is a, c, g, or t
  misc_feature (426)..(426): n is a, c, g, or t
  misc_feature (456)..(456): n is a, c, g, or t
  misc_feature (473)..(473): n is a, c, g, or t
tgnancnatctcccagcctaacctctttattgtattgatggggaggctaaggctgaaagaagagatgtgacttggccagggttacctagagggttaaaaacccagcttaactggatgccacaccctctcaaccacacttgctgagtattctaactgcatgggttgggtatatggcactggaggccctctttgggggcacttacaagctatggctccagatagccaagaagccaaagcagctggtntccancaggggaaggaaacaaactggactgagcatgtgggcttctcactcactgcagcctgggggtggggaaagggggtnttcacctcctccctaaaagggcatctgggagcacagtgggggtccagtcgggtacatgtctttcactcaggcagggctttgcagggcacagcgccggggtnttccacgtcctgggggccatgggggccagnccaccgtgggtcaccgnttttttttcccc

SEQ ID NO: 111 - DNA, 355 bp, Homo sapiens
tataccatgaggtcatagcaatcattcctctaatagaagctgacaggacataaagacagaactatctgatgaacacacacaatgactagaaatatatagagagatagagacagtgaaaagacttagtttacctctgagaaaccatcccccaaaataaatcctgtattaacaagtgcaaaaaataaacaaacaaataaacccaaaccaaaacgaaagcaaataaaacctccaaacattaaaacacagtgtatgaaatggtgtgagaaatttaaagtcactttccagccttttagtcaataaaaagctgtggttgtgtccttgtttggattcaggcccatctgtttaaattttaccc

SEQ ID NO: 112 - DNA, 3141 bp, Homo sapiens
aattagtgaaaggatgcaggttagtcaggggttaagctcattaagtcagccttgcagatacaagtggtggcttaattatcctggagcagagctcattgcctgagagcactttaaaagagtctctgcttttcctttatcctagagggcaagcaagctggctggttactaactatattgtcaaaagctgtcctagactcactcctaagttgctgctgattaactgttcagtctaatatctggactctaatagaaggcagcacttttggtttggtaggagacaaattggaaggctgggcatcaagtaagttaaagtcgtccatttatcaaacacaatgcataagagacacagaggctcccgtttccatggacgagacacgcagctgaaagagatgagctgtggacacttagaccttgtattgagatgaattggcaggccaagaggaaaagaagaaagtggttgggaaatattttttggaactggtgaggcattcctgcaagggaaatcaatctaaaactaaacattctttccacaatgtgtgtatgaaatacacttactttattttatggagatgcggtcttgctatattgcccaggctggtctcaaacccctggcctcaagcaatcctcccacctaggcctcccaaagtgctgggattacaggtgagagccactgcacctggctacacgtgttttaatccttgaaaatcctcaatccctttcattatttttatactgattggtcttcccaactgtaatttgtttccagactctcatattctaagtgtctgttctccacggtctttcactgagtctagagcagaagcaaggtcaccattctttggcactcagttaacatactatgttttgctatggcttagcagaaattaagtgctgtaacctattgggaatctcaggagggacttttttgtgtttttttttttttgagacggagtctcactctgtcacccaggctggagtgcagtggcgcaacctcggctcactacaagctccacctcccgggttcgcgccattctcctgcctcagcctcccgggtggctggagctacaggcgcttgccaccacgcccggctaattttttgtatttttggtagagacagggtttcaccatgttggccaggagggtcttgatctcctgacctcgtggtccgcccatctcggcctcacaaagtgctgggattacaggtgtgagccaccgcgcccggccaggagtgacatttaagctagtcagtttaaatcaaatctttgttctatgtgacttacccagtacttcccaataatcttatccactccacaccttctacagtcaactgaagactacccaaaggagcactgctcatgcatatggcacagcagagcaccgggacctgcccagctcctctctgaagctctgtaatcaggcagctaccaaggaagagtcagacttcaacagtttttacacaaggaatctcaaaatcttaagttggaaggacaccttccatgatttgattcccagccacataaaacctgttatctttcatttataaatggggggaatggggcagagaaagctcctgttaataaaagaggaggccacgcgcagcggctcatgtctgtaatctcagcactttgggaggctgaggtgggcggatcgcggggtcaggagatcgggaccgtcctggccggcatggtgaggcctcatctctactaaaaatacaaaaattggctgggcgtggtggcgggcgcctgtggtcccagctactcgggaggctgaggcaggagagtcgctggaacccgggaggcagaggtcgcagtgagtcgagatcacaccacggcactccagcctggcgacagagcaggactccatctcaaaaaaaaaaaaaaaaaaaaacaaaaacttggggggaataaggggctacagaaaggcataggacaaatcagtgatgttgaaccacatcttactaagatgctttgcttgctgtggcactctaaactctcttgcttgcttccatgacaatacatccaggtgatctcagaaaattgtgcagtgaataggctactgtgaaactacgactttcctctcattatacaccagcaatacatacagctcaacagtctcagtttaatgacaagaatgtaggatttcacaagcttctaaccataaattcagcttttcaagagcaaatgctttgaggatcgtcttaagaattataaaaaaactattgtgagagatctgcaaatttaggtttaggccactgctgatatcctaaactaagtgagatctgtaatgtctgcaagttagtcagaggtgaggaaggaaagcagcaccagtatccacaggacaccagcaccatccatggagttctcaagggccactcaaaaaagcctgcattctgaacacttgttgttttatagtatttggtgcttctggtcgtcaccatgtcctcccacgcccactacacacatacacacatcccctgcatagtgcaacataacattgcaaagccacaaagaaatgtatcagagaactagtatacggacccaacaaagcttcaggaggaccttgttagacccaattaaagccatatggcatctagtgaacacatttttaaaaggctatcctgtagctcagaaattacaaaataccacagaaagaaatgtcaacaactccaattctttactacacattaagctactgaaagtaacaggcctcaagaaaatcgtattattcactgcattttcttcactgtgataaaaaaaaaaaacctcaatatacatgtgtagcaaaaaaaaaaattcacttgtatgtaggactcaaaatattcttgcagcacataacattccaagccatttccttatatgcaaaacagaatttttaaaaaaagcaggaagacattggcaatattcctattttctgtagatgctagtagtgttttattcctatgttgtgaatcagattgtcactatagcatgtttctacagttgtttgtgtaagtcatttgtgtttggcctttttcttgtagaaaaaataaatcttgaattttgtgtatttaagtctgaaaagcaaaatgttcttcaaataaaaggctatctttgaagaacaaaaaaaaaaaaaaaaaaaaaaaaaaaaaaaaaaaaaaaaaaa

SEQ ID NO: 113 - DNA, 785 bp, Homo sapiens
  misc_feature (9)..(9): n is a, c, g, or t
  misc_feature (663)..(663): n is a, c, g, or t
agcccaggnaatgaaatgcagagaacattgtggagatatattttctgttatccccattcgaaatagatcaggctgcactgataacagctgcaaaaacaattggggaccttattcataaaatcaaaggtaaactgccagatggcaaccaaccagaggacctgaggatgaagaggattgcaaaatgctggtgacatagagaacaaaccctttggagaataaacatgtctgtatctttgttaaaatgtagaaatcagaatttttcccaaacttgcaagtaatagagaataaaataaaaacaacaagtgtttgttaactagaaagtttgcctatggaaaaaaacaattttcttagttgaaaatgtgacgggctgttcaggcttctctgtcattcttcttgtctctcttcataatctctatgtaatgcagaaacagccagtaaaagaagagaatctgtgcgtctttaattacttcctgtaagtttcacaagtactaccacagtctcattggctatgctacatctaaataagccactctttcaaagacagcataattatttgcatacacttgcttccctagctatatatcatgcctatcaaaactaagtgcttccaacctaccttaacagtgtcttagcatctatctcacttggtactaaattctgggntggtaaatattcaaaccatttatgataatatatactcataatctgaactaaaacccagaacagaatttattaaaattgaggataaaaataaactcaatctttatgacaaaaaaaaaaaaaaa

SEQ ID NO: 114 - DNA, 355 bp, Homo sapiens
gtggctactgatattccttggtttgtggctgcatcactccagtcctcaccttcatgatcacactgccttctcctcttctgtctgcaatctccctgcctctgattaaagacacttgtgattgcatttaggacctacctagataatccaagaaaatctccccatctcaagatctccaatttaatcacatctgcaaacacctcatttccacgtaaggtaacatagggttcatggattaggacctgatgtcttgggggccattattcagcctactacaacatatatttatatacttgtgcctggatgagttctcagtactttaagtgtcttaacttcctctcaaacaatatatgacata

SEQ ID NO: 115 - DNA, 7343 bp, Homo sapiens
agtctgcgggcctccggggctgcggcgaggccggagcgtcgcggcggagaggacgagaccgggacaagaccagggcaggagggagccggccagccgcgagaaccccgcacgcccggcaagatgctgtccttgcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccgactgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtttggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagtgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatacttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaagtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggaggtgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtgggggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcacaggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcacactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 116 - DNA, 614 bp, Homo sapiens
ttttttcagttcattttttattttttaatgaacattgaggattcatatacaaaagctgacagagcagtaagtccagtcatgaaatacatacaaggaaataaaatggaaaataactcaattacaatttctcaccactgaagcactacacgctggctgtagggagaggtggtcagtgtttcagagacagcgatcacatgggccaagtgctgagaatgtcatcaaaacactgtttgtttaacatctcctttcctttcttggctattgttcaggtagtgggtggtgtggggtaagaaatgtttctttttcttcccaaaaaatttaagcagttgattttttttcctcagggaaatattttgtgtatctaacatatgatgtatttctgttattaatctgcctgcataaaagtttgcctattctatttcttcgtgtaagatcatgcagtactttcctaatttcagaacagtaagaattatcaaaggcaattcattttgtacataaatgtccaagtttcctcataatggaaaacgtgctctttatgatctctgtttctcgcaatatagttggtcaactaataatcatggaagtttcctaaaattttattcactgggaaaatt

SEQ ID NO: 117 - DNA, 1224 bp, Homo sapiens
gcccattgtttttgtaatctctgaggagaagcagcagcaaacatttgctagtcagacaagtgacagggaatggattccaaacaccagtgtgtaaagctaaatgatggccacttcatgcctgtattgggatttggcacctatgcacctccagaggttccgagaagtaaagctttggaggtcacaaaattagcaatagaagctgggttccgccatatagattctgctcatttatacaataatgaggagcaggttggactggccatccgaagcaagattgcagatggcagtgtgaagagagaagacatattctacacttcaaagctttggtccacttttcatcgaccagagttggtccgaccagccttggaaaactcactgaagaaagctcaattggactatgttgacctctatcttattcattctccaatgtctctaaagccaggtgaggaactttcaccaacagatgaaaatggaaaagtaatatttgacatagtggatctctgtaccacctgggaggccatggagaagtgtaaggatgcaggattggccaagtccattggggtgtcaaacttcaaccgcaggcagctggagatgatcctcaacaagccaggactcaagtacaagcctgtctgcaaccaggtagaatgtcatccgtatttcaaccggagtaaattgctagatttctgcaagtcgaaagatattgttctggttgcctatagtgctctgggatctcaacgagacaaacgatgggtggacccgaactccccggtgctcttggaggacccagtcctttgtgccttggcaaaaaagcacaagcgaaccccagccctgattgccctgcgctaccagctgcagcgtggggttgtggtcctggccaagagctacaatgagcagcgcatcagacagaacgtgcaggtttttgagttccagttgactgcagaggacatgaaagccatagatggcctagacagaaatctccactattttaacagtgatagttttgctagccaccctaattatccatattcagatgaatattaacatggagggctttgcctgatgtctaccagaagccctgtgtgtggatggtgacgcagaggacgtctctatgccggtgactggacatatcacctctacttaaatccgtcctgtttagcgacttcagtcaactacagctgagtccataggccagaaagacaataaatttttatcattttgaaataa

SEQ ID NO: 118 - DNA, 4242 bp, Homo sapiens
gggtcagtcagtcgctccctgtcgctgccggagagtctctgcttcccccttcctacgcgctccgcggcggtagctcgggctctccggaggagggggcgacagagtaaaagagaggctgacttaataaagtttcctgaaacaacaactaccaccgaaaaggcccaaggtggggggagacccccatttttctccgcccctctcctaaagcctgagggaccgttgcaggtggagcggcgctggtgggacccgggttgcggcggcagccgttgccccggcgagggaagcctcaggtcctgcccgctccggttccggctccttcggtggtggcggcggcagctgctgccgggcggttcctcctgtcaactgcctccgcccgcgcgcctcccgcctagccacacagcgcggaggacgccgtgagccgccgccgcagtcgtctcggcccgcggagggacgtggtgagctgtggcgcttccgcgtcagcgccggcggggactctttgggagcgcgtcgggcccgagtccgggttcccccgcgtggtcagcggaggctgcgccaggtggggcccgcagccgcctcccacgccaggctgtccccgcggccgcccggcctgccttccttccttccgcccgcccgccggcccgccctaagagttgaccacgccgcaatgaagagcttcttacagtgaaagcaaagtaggtcgagtccactgaaaatgcctttaagggacaaatactgtcagactgaccaccatcatcacggatgctgtgaaccagtttatatcctggaacctggagatcctcctttgttacagcaaccactacagacatccaaatctggtattcaacaaataattgagtgctttcgatcaggaactaaacaacttaagcatattttattaaaagatgtggacactatttttgaatgtaagttatgccgcagtctcttcagaggattaccaaatttaattacccataaaaaattctactgcccaccaagtctccagatggatgacaaccttcctgatgtaaatgataaacaaagccaagccataaatgatctcctagaagccatatatccaagtgtggacaaacgagaatatattattaagctagaacccatagaaactaatcaaaatgcagtatttcaatatatttcgaggactgataatcctattgaagtcacagagtcaagcagtactcctgaacaaaccgaagttcagatacaggaaactagcactgaacagtcaaaaacagtaccggttacagatacagaggtggaaactgtagagccccctcctgttgagattgttacagatgaagttgcacctacatctgatgaacaacctcaggagtcgcaggctgacttggaaacttctgacaattctgattttggtcaccagttgatatgttgtctttgtagaaaagaattcaattctagacgaggtgttcgccgtcacattcgaaaagtacacaagaaaaagatggaagaactaaaaaagtacattgaaacacgaaagaatccaaaccaatcctctaaaggacgcagtaagaatgttctagttccattaagtaggagttgtccagtatgttgtaaatcatttgctacaaaagcgaatgtaaggaggcattttgatgaagttcatagaggactaaggagggattcaattactcctgatatagcaacaaagcctgggcaacctttgttcctggattctatttctcctaaaaaatcttttaagactcgaaaacaaaagtcttcttcaaaggctgaatacaatttaactgcatgcaaatgcctcctttgcaagaggaaatatagttcacaaataatgcttaaaagacatatgcaaattgtccacaagataactctttctggaacaaactctaaaagagaaaaaggccctaataatactgccaacagttcagaaataaaagttaaagttgaaccagcagattctgtagaatcttcacccccttccattacccattctccacagaatgaattaaagggaacaaatcattcaaatgaaaaaaagaacacaccggcagcacagaaaaataaagttaaacaagactctgaaagccctaaatcaactagtccgtcggctgcaggtggccagcaaaaaaccagaaaaccaaaactttcagctggctttgactttaagcaactttactgtaaactttgtaaacgtcagtttacttccaaacagaacttgactaaacacatcgagttgcacacagatggaaataacatttatgttaaattctacaagtgtcctctttgcacttatgaaactcgtcggaaacgtgatgtgatacgacatataactgtggttcataaaaagtcatctcgttatcttgggaaaataacagccagtttagagatcagagctataaaaaagcctattgattttgttctaaataaagtggcaaaaagaggcccttcgagggatgaagcaaaacatagtgattcaaaacatgatggcacttctaactctcctagtaaaaagtatgaagtagctgacgtcggtattgaagtaaaagtcacaaaaaacttttctcttcacagatgcaataaatgtggaaaggcatttgccaaaaagacttaccttgaacatcataagaaaactcataaggcaaatgcttccaattcacctgaaggaaacaaaaccaaaggccgaagtacaagatctaaggctcttgtctgataacttcaagtgatgtacgaaaaggtttggagttcatttttgtggaaagactttaaattggtgttagaaccactaaacatcttcaaatggtactatgaggaaaaaaagaaaaacatttttctaaatattcaactataactgctgttttctgactaaaataaccatctaaccacttgtttctaaggcactgcctattccagcactttcaagtagctgtgatattacatgttgtcatcacagtccatcagctatccacccttgaccttgtgcatttggtcgacagtttctacaaaaatgttacaaattttgttttctaaacaatttgttgattaagtgatcaacaacctgaagaaaatatcaatttttaattgacaaagactttatatcttagtgattttagttttgtttctctttatttggcaacattttcatctgaattgtatagatatatgattttctagtgagtgtatgttaggaacaaaagacaaaatagtatcaacacattataaatatttagcttactaaatatttgtaattatttttacatccatttatttctagcttgttctccagcacttcagtgtttgaaagtttcatcctaaaatatatactacaggaaagctgcagttcattttcatgcatggatcattacatttttcacttgtaaatgtaggtttttatgaaaattaaacattcccctatttttctttaaattttatacaaagcactttaatgatagatgcaaccttatttttcagttcctatttttttaaagaccacacatttactaatgttaatatgaaggtaataaatagcttactgatattttatggatgcagacaatccatgcacaaccacttcttatgatactagtttatttccttaaatattgctacaaaaggaagatgcgggtgtaagccctgatttttttttctcccaagaaaaatcttaaaggaccactttagataatatttgattcctactgtaaaatttagaaaatgatgaattcttgtccatttttgtaatcaagattttaggaaaaacagaagtacatctatctttatgaaattttgggcaggtttttgtgtatcaatattttgtacttttagggaatattttattttttagttatttgtgtcaaattataattataaaaggtacagcagaaaatataccatgtttttatataggttcacacctgtacttaggagggaccctgtccatctatatactttttgtataaaattttaaaatgttaaagatccacaaggtcttaataaaatgattctatagctagaaaaacatttaccttcccagtgctttgcactaaaatatactgtgaaaggaaactagaaagactgtaactattgctggaaatgttctatattgaatgtacatgctcttgttggaaaaatgtactatatgtgatggaaataaaccagaatcgaagttatttcagctaaatgtgcttcagcaaaggtgcattggttgaaacttaaatgttttattatcaaaaaaaaaaaaaaaaaaaaaaa

SEQ ID NO: 119 - DNA, 674 bp, Homo sapiens
  misc_feature (616)..(616): n is a, c, g, or t
ctaatggaatattaaacgtggctgcacacatattcagagcaagatgctgaaatctctaaagtttgatcacctatttttaatggcatccttttgctttttgttgttacctatggctgagtgcccttcttatgcatgaggctgctgccctcttgtggcaattttaaaaagggctgggaagacgaggagggtgaagggaaaggaaaaaaaatggattgttgagaagcagtaaagagaggaaagcagggatgttaaatcactttagattgcaatgatcataagggctgaaaccctatatttttaagatcctggtgataaatacctaaatcgtcatgcactggggaaaaagtggtatctattctatagtcccagtcttgattattaaacattactgaggtgccgttgtgagccaagaccatattataccacctctccttgccctaatgcacaaactccaagtgcatatctggttttcatctagggggttttacatttgccccagctgctgaagataaggaccttctctctgttcctgaactatttgcaatatcatagaattgttttaggttatcttttttctggctatagagtaatacattccttataaaagctcaaacantgtcaaaatgtaaatcttagaaagcaaaagtctcctctaattccaccttgcagaggta

SEQ ID NO: 120 - DNA, 3300 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcgacctgcgcaaagggcgggcctgtttggtgaggacctgcggccttgggt

SEQ ID NO: 121 - DNA, 1243 bp, Homo sapiens
gcagccaccgtccccacgctggggcttcaggtctcctagcaacaagttgtaccatatgaggacggccgctgagccataatggagatatcaatgcctccacctcagatatatgtagaaaaaactctggccattatcaaaccagatattgttgacaaagaggaggagatacaagatattattcttagatccggattcaccattgttcagagaagaaaactacgcctcagccctgagcaatgtagtaacttttatgtggaaaagtatggaaaaatgtttttccccaacttaacagcttacatgagttctggaccacttgtcgccatgatattagctagacataaagccatctcttattggttagaacttttgggaccaaataatagcttagtagcgaaggagacacatccagacagtctgagggcaatttatggcacagatgacctaaggaatgcacttcatgggagtaatgactttgctgctgcggaaagagaaatacgttttatgtttcctgaagtgattgttgagcccattccaattggacaagctgctaaggactatttaaatttacatataatgccaactctgcttgaaggactcacagagctttgtaagcaaaaaccagcagatcctttgatttggctagctgattggctgctgaaaaataatcctaacaaacccaaactttgtcaccatccaattgtagaagaaccttattaaaaaaaaaatcctcgaaagaacaaatcatgaactatcttattataaaaggctgtacttctactgtttgaaaaaattatttctagggtttaagtaactacaagtaaaataaatttatttcttaaaaataagtgttaaaggaataactattctatgaagcagataacattaaggtaaaatataggcttagagtatgattttaacaatgatgtaacactaggtaatggaaaactcatgtaagatgttgctagatgtttttgtttttcttaagtttgagaagtaagacataaagtttagttatacattttcccaagcacatatcctatatctaaatacataattaatgcacagttgagacagtctagtttaaaaggcttaggtccttttgtagtccataagcatggtgatttggtttcatgctcatgtgtcagatatgcttccctcaaaccttgttacagcatcatcacattacctgtttgatgtaaaaaataaaaaatagaaaggtgtaagtaaaaaaaaaaaaaaaaaa

SEQ ID NO: 122 - DNA, 1518 bp, Homo sapiens
gtgcttttggaaaagatcatatgacagctataaagactctgatgaaaggttactagcaggttattcaaaggtactttttttgaaggcaagattttaaggcatgttagggtaggcattcaagtagggtgattttttaaaaatgtatttgcttgccgcagaagacaagtacaggttctgctctgatgcctgtcctggtcctctttcccttttaatgttagaatgtggcaaatgctcagtaatcactgagctagggatttccaaggctcttgtctttgtctgcatcccaggtccagggattgtacagttggtaaactgtaccaaagcatggagaccaggtgtttacgaggattgaagcatagttggtgctcctttcaccaagccttgtaccacaagcctagtgctgtatccatccagagacaagggtgccgttttccttactccaaatttacataagctaccagtgtttgcacccatgctgggctggccccacccagaggagggtgctttttctaactcacaaccaaacatacaggcagaaatggtcctgcctgtgcctacttctctgttagaaaagaaacactcctcttactcacactcatcggattccagttaagccactgtttgcaggggcattccctgaggaaattcgggctggagaagagagatgaaaatatctttctcaattctacctttgtataggaactccattctttgtctatccatagactattggattcccttagcctatatgtgaagaaggatctgatacagagcctaagtcttactgagagccttagaattgtctttagtgaagtgttaaatagtcgctttcaagcattcacttttgtagatgtcttcgcaggatttaaagaaagaataaaacatgccaggatatttatgaatcatgagatttaatagagaccaaagtagatcttattactgatgtgcttactgcttcattaaattccctttaaggtttgcggcttggatatggatcatttgcaataataattaggcagtgatcgattgattgggtctgacattgcacttgtcaccttgaaatgcaaaatccatctattttcaacagtgaacatttctcgctaatcttgcacaccagcatgtgatagtttattttatggagaaagtacaatttataaagtttggagacttaacattaaccttttactaagaatgaagtatcacttgtcattttacaaagaaatgaaaatcatccaaccagcaatttttttgagattagaaaacacagcctaatttcaaaagaatttttcaaatccaaaacgcatgcacttcaattgagtgctacaagtatattgtgagtattggagtttactaaaccttcacatggagtataaatgataaaattgtgagcttgagactagctctgctgtgtgtacagacacacacacacacatttagacacacacacgtctatttgtctatctatttccacatttaattccctaattctatctttgcctcaaaaaaaaaaaaaaaaaa

SEQ ID NO: 123 - DNA, 1819 bp, Homo sapiens
cttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctctgccccagttggggcaggggcaggagggagggtttctctcccaagctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagacttcccggggtccccgccctctctcatatcactgaaggatattttcaacaattagaggaatttaaagaggaaaaaaattacaaagaaaataataaaagtgtttgtacgttttcaaaaaaa

SEQ ID NO: 124 - DNA, 8107 bp, Homo sapiens
tgagggaagaagaggaagcgggaggagcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccaaaaatgtgatgagccacttgtctctggactcccccatgtggctttcagcagctcctcctccatctctggtagctattctcccggctatgccaagataaacaagagaggaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtgggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacagatgtgtgcccaatcactgtgagcatggtggaaagtgctcgcaaacatgggacagcttcaaatgcacttgtgatgagacaggatacagtggggccacctgccacaactctatctacgagccttcctgtgaagcctacaaacacctaggacagacatcaaattattactggatagatcctgatggcagcggacctctggggcctctgaaagtttactgcaacatgacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggaggaaggatgctggtttcttatcatacaaagatcacctgccagtgagccaagtggtggttggagatactgaccgtcaaggctcagaagccaaattgagcgtaggtcctctgcgctgccaaggagacaggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggaagcttacagattcgatacaacctgggtggcacccgagagccatacaatattgacgtagaccacaggaacatggccaatggacagccccacagtgtcaacatcacccgccacgagaagaccatctttctcaagctcgatcattatccttctgtgagttaccatctgccaagttcatccgacaccctcttcaattctcccaagtcgctctttctgggaaaagttatagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcagccagtgcggattttccatataatccaggacaaggccaagctataagaaatggagtcaacagaaactcggctatcattggaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaaaacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggcggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccgtgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcct

SEQ ID NO: 125 - DNA, 243 bp, Homo sapiens
cacatcacttatgtaatggagctagataaaagccacaatgcttttgtaggcagggttcaggccaatatttcacatcagctgggcgctggtctcagtgatatgtaaaagtgccctcgattccattgccaaatgaggtgttatacattgcttggttgcttggtgtacatatgtcacaatttcaactgtgctctgggcctgtgtgcctgggcttgcaatatgtcattatccttcctttgtgtgggg

SEQ ID NO: 126 - DNA, 4755 bp, Homo sapiens
gctgctctcgttcgcttggctcagctcagctcagctcagcgcagctccgcggccgccaagccgaggcgggcacggtctccgagtcgcggacgccagctccgagctccctctctccgccgcgcctccgccaggtcgcgccttcgtcgggaccacttcgggcaggagtcgcgtggcgaaggcctgcggccgcggcacaaagttgggggccgcgaagatgaggctgtccccggcgcccctgaagctgagccggactccggcactgctggccctggcgctgcccctggccgcggcgctggccttctccgacgagaccctggacaaagtgcccaagtcagagggctactgcagccgtatcctgcgcgcccagggcacgcggcgcgagggctacaccgagttcagcctccgcgtggagggcgaccccgacttctacaagccgggaaccagctaccgcgtaacactttcagctgctcctccctcctacttcagaggattcacattaattgccctcagagagaacagagagggtgataaggaagaagaccatgctgggaccttccagatcatagacgaagaagaaactcagtttatgagcaattgccctgttgcagtcactgaaagcactccacggaggaggacccggatccaggtgttttggatagcaccaccagcgggaacaggctgcgtgattctgaaggccagcatcgtacaaaaacgcattatttattttcaagatgagggctctctgaccaagaaactttgtgaacaagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccagtggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggccccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtacagcgccacctgcggcatgggcatgaagaagcggcaccgcatgatcaagatgaaccccgcagatggctccatgtgcaaagccgagacatcacaggcagagaagcgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacagtataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactac

SEQ ID NO: 127 - DNA, 2929 bp, Homo sapiens
agccatttgtgaacctggaggcttgacattcgccagcgcagggccccacaagagaaatttcaatgaaaagaaaagccaatggattgtggtcttagaaaagctgcttagatgatgtctgtttcccgtgctatagacacgtggcagagctgtaagtaaatgctcggcactgcatgatgaattggatggctgcagaccggagacaaaaaaaataattgtctcattttcgtggtgatttgcttaactggtgggaccatgccagaacggctagcggaaatgctcttggatctctggactccattaataatattatggattactcttcccccttgcatttacatggctccgatgaatcagtctcaagttttaatgagtggatcccctttggaactaaacagtctgggtgaagaacagcgaattttgaaccgctccaaaagaggctgggtttggaatcaaatgtttgtcctggaagagttttctggacctgaaccgattcttgttggccggctacacacagacctggatcctgggagcaaaaaaatcaagtatatcctatcaggtgatggagctgggaccatatttcaaataaatgatgtaactggagatatccatgctataaaaagacttgaccgggaggaaaaggctgagtataccctaacagctcaagcagtggactgggagacaagcaaacctctggagcctccttctgaatttattattaaagttcaagacatcaatgacaatgcaccagagtttcttaatggaccctatcatgctactgtgccagaaatgtccattttgggtacatctgtcactaacgtcactgcgaccgacgctgatgacccagtttatggaaacagtgcaaagttggtttatagtatattggaagggcagccttatttttccattgagcctgaaacagctattataaaaactgcccttcccaacatggacagagaagccaaggaggagtacctggttgttatccaagccaaagatatgggtggacactctggtggcctgtctgggaccacgacacttacagtgactcttactgatgttaatgacaatcctccaaaatttgcacagagcctgtatcacttctcagtaccggaagatgtggttcttggcactgcaataggaagggtgaaggccaatgatcaggatattggtgaaaatgcacagtcatcatatgatatcatcgatggagatggaacagcactttttgaaatcacttctgatgcccaggcccaggatggcattataaggctaagaaaacctctggactttgagaccaaaaaatcctatacgctaaaggtagaggcagccaatgtccatattgacccacgcttcagtggcagggggccctttaaagacacggcgacagtcaaaatcgtggttgaagatgctgatgagcctccggtcttctcttcaccgacttacctacttgaagttcatgaaaatgctgctctaaactccgtgattgggcaagtgactgctcgtgaccctgatatcacttccagtcctataaggttttccatcgaccggcacactgacctggagaggcagttcaacattaatgcagacgatgggaagataacgctggcaacaccacttgacagagaattaagtgtatggcacaacataacaatcattgctactgaaattaggaaccacagtcagatatcacgagtacctgttgctattaaagtgctggatgtcaatgacaacgcccctgaattcgcatccgaatatgaggcatttttatgtgaaaatggaaaacccggccaagtcattcaaactgttagcgccatggacaaagatgatcccaaaaacggacattatttcttatacagtctccttccagaaatggtcaacaatccgaatttcaccatcaagaaaaatgaagataattccctcagtattttggcaaagcataatggattcaaccgccagaagcaagaagtctatcttttaccaatcataatcagtgatagtggaaatcctccactgagcagcactagcaccttgacaatcagggtctgtggctgcagcaatgacggtgtcgtccagtcttgcaatgtcgaagcttatgtccttccaattggactcagtatgggcgccttaattgccatattagcatgcatcattttgctgttagtcatcgtggtgctgtttgtaactctacggcggcataaaaatgaaccattaattatcaaagatgatgaagacgttcgagaaaacatcattcgctacgatgatgaaggaggaggggaggaggacacagaggcttttgacattgcaactttacaaaatccagatggaattaatggatttttaccccgtaaggatattaaaccagatttgcagtttatgccaaggcaagggcttgctccagttccaaatggtgttgatgtcgatgaatttataaatgtaaggctgcatgaggcagataatgatcccacggccccgccatatgactccattcagatatatggctatgaaggccgagggtcagtggctggctccctcagctccttggagtccaccacatcagactcagaccagaattttgactacctcagtgactggggtccccgctttaagagactgggcgaactctactctgttggtgaaagtgacaaagaaacttgacagtggattataaataaatcactggaactgagcattctgtaatattctagggtcactccccttagatacaaccaatgtggctatttgttttagaggcaagtttagcaccagtcatctataaactcaaccacattttaatgttgaaccaaaaaaagataataaaataaaaaagtatatgttaggaggttataaatcttgtggagtgtgaattaagtatgtggagtgtctagaagtccttggatatttgatatttacctgaccaccacagacaaagatt

SEQ ID NO: 128 - DNA, 3321 bp, Homo sapiens
cagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccggtcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaaagaaaaaaaaaggtgactcacattgttacacatgctttaaaatatgtgttcaaatgttattaaccacaatgacgacctgttttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgag

SEQ ID NO: 129 - DNA, 2740 bp, Homo sapiens
ggcggcggcggcggcggcgaagaactgttccttccacctcttcagccccggcaggacgggggcggccgccgcgaacccggggcggggacagcacgcagcctcgaggcgcgcacccccgcccggcagcggccccgacacccggggcgagcgggaaaacggcaacggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctactacgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagaccccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccactcgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaa

SEQ ID NO: 130 - DNA, 4779 bp, Homo sapiens
tgcgaccgcctccctgcgccccgcccctccggctagctcgctggctcccggctcctcccgacgtctcctacctcctcacggctcttcccggcgctctcctggctcccttctgccccagctccgtctcggcggcggcgggcagttgcagtggtgcagaatggctgacctcagtcttgcagatgcattaacagaaccatctccagacattgagggagagataaagcgggacttcattgccacactagaggcagaggcctttgatgatgttgtgggagaaactgttggaaaaacagactatattcctctcctggatgttgatgagaaaaccgggaactcagagtcaaagaagaaaccgtgctcagaaactagccagattgaagatactccatcttctaaaccaacactcctagccaatggtggtcatggagtagaagggagcgatactacagggtctccaactgaattccttgaagagaaaatggcctaccaggaatacccaaatagccagaactggccagaagataccaacttttgtttccaacctgagcaagtggtcgatcctatccagactgatccctttaagatgtaccatgatgatgacctggcagatttggtctttccctccagtgcgacagctgatacttcaatatttgcaggacaaaatgatcccttgaaagacagttacggtatgtctccctgcaacacagctgttgtacctcaggggtggtctgtggaagccttaaactctccacactcagagtcctttgtttccccagaggctgttgcagaacctcctcagccaacggcagttcccttagagctagccaaggagatagaaatggcatcagaagagaggccaccagcacaagcattggaaataatgatgggactgaagactactgacatggcaccatctaaagaaacagagatggccctcgccaaggacatggcactagctacaaaaaccgaggtggcattggctaaagatatggaatcacccaccaaattagatgtgacactggccaaggacatgcagccatccatggaatcagatatggccctagtcaaggacatggaactacccacagaaaaagaagtggccctggttaaggatgtcagatggcccacagaaacagatgtatcttcagccaagaatgtggtactgcccacagaaacagaggtagccccagccaaggatgtgacactgttgaaagaaacagagagggcatctcctataaaaatggacttagccccttccaaggacatgggaccacccaaagaaaacaagaaagaaacagagagggcatctcctataaaaatggacttggctccttccaaggacatgggaccacccaaagaaaacaagatagtcccagccaaggatttggtattactctcagaaatagaggtggcacaggctaatgacattatatcatccacagaaatatcctctgctgagaaggtggctttgtcctcagaaacagaggtagccctggccagggacatgacactgcccccggaaaccaacgtgatcttgaccaaggataaagcactacctttagaagcagaggtggccccagtcaaggacatggctcaactcccagaaacagaaatagccccggccaaggatgtggctccgtccacagtaaaagaagtgggcttgttgaaggacatgtctccactatcagaaacagaaatggctctgggcaaggatgtgactccacctccagaaacagaagtagttctcatcaagaacgtatgtctgcctccagaaatggaggtggccctgactgaggatcaggtcccagccctcaaaacagaagcacccctggctaaggatggggttctgaccctggccaacaatgtgactccagccaaagatgttccaccactctcagaaacagaggcaacaccagttccaattaaagacatggaaattgcacaaacacaaaaaggaataagtgaggattcccatttagaatctctgcaggatgtggggcagtcagctgcacctactttcatgatttcaccagaaaccatcacaggaacggggaaaaagtgcagcttgccggccgaggaggattctgtgttagaaaaactaggggaaaggaaaccatgcaacagtcaaccttctgagctttcttcagagacctcaggaatagccaggccagaagaaggaaggcctgtggtgagtgggacaggaaatgacatcaccaccccaccgaacaaggagctcccaccaagcccagagaagaaaacaaagcctttggccaccactcaacctgcaaagacttcaacatcgaaagccaaaacacagcccacttctctccctaagcagccagctcccaccaccattggtgggttgaataaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcaaaaaccacaacagctgctgctgttgcctcaactggcccaagcagtaggagcccctccacgctcctgcccaagaagcccactgccattaagactgagggaaaacctgcagaagtcaagaagatgactgcaaagtctgtaccagctgacttgagtcgcccaaagagcacctccaccagttccatgaagaaaaccaccactctcagtgggacagcccccgctgcaggggtggttcccagccgagtcaaggccacacccatgccctcccggccctccacaactcctttcatagacaagaagcccacctcggccaaacccagctccaccaccccccggctcagccgcctggccaccaatacttctgctcctgatctgaagaatgtccgctccaaggttggctccacggaaaacatcaagcatcagcctggaggaggccgggccaaagtagagaaaaaaacagaggcagctgctacaacccgaaagcctgaatctaatgcagtcactaaaacagccggcccaattgcaagtgcacagaaacaacctgcggggaaagtccagatagtctccaaaaaagtgagctacagccatattcagtccaagtgtggttccaaggacaatattaagcatgtccctggaggtggtaatgttcagattcagaacaagaaagtggacatctctaaggtctcctccaagtgtgggtctaaggctaacatcaagcacaagcctggtggaggagatgtcaagattgaaagtcagaagttgaacttcaaggagaaggcccaggccaaggtgggatccctcgataatgtgggccacctacctgcaggaggtgctgtgaagactgagggcggtggcagcgaggctcctctgtgtccgggtccccctgctggggaggagccggccatctctgaggcagcgcctgaagctggcgcccccacttcagccagtggcctcaatggccaccccaccctgtcagggggtggtgaccaaagggaggcccagaccttggacagccagatccaggagacaagcatctaatgatgacattctggtctcgtcttccgtctcccccgtgttcccctcttgtctcccctgttcccctctcccttccctcctcccatgtcactgcagattgagacctacaggctgacgttccgggcaaatgccagggcccgcaccgaccacggggccgacattgtctcccgccccccacacttccctggcggccccaactcgggctcccgggtccttggccccctttcccgggctgtccactagaccagtgagcgcttgggcgccgtgctgggcagcccgctaggctcgccttccctcctgctttgcgtgcccggggcagcagcagccctgccccacacctcctctcactccccagcctgggcccatctccctgctttggtcttgccccatcactgcgccactgctccgtggaggaggttgggagggggttggggtggttgaggctaagttgggatctaggagaggagaaccagattctatcctcatctttttttggttctttggtccaaacccaaaagaaactgacatgccctcccttctccctggatctacctggagggaagagtggaggtggattccgagtggtgacaggacgctgaccgtggagcttaagccactgcctctccctctggtcccacaaatgggcgcccccccctccccatgcaggtggtgtcgggcccttcttgctgccctgccccaagttgggggtcagtgctgcctgtccccatgcttaacatacccgcctagctgctgtcacatttttcttgttttgtccttttatttttttctaataacctaaaaactggcaaaatagttctgcaggttgaagccatgtctacatgaaagtcctcagtaagtgttagagggaacagggcggagatatccttatgccacccccgctggaggatgtgggcagcttagggccctggaggcggtgcggcagggaagaggggtgcagaggctgtggctggtgagccggtcaggcacacaaggggcccttggagcgtggactggttggttttgccattttgttgtgtgtatgctgcttttcttttctaaccaagaggctggttttggcatctctgtcccattccctgggatctggtggtcagccctaggataaaaagccagggctggagaacaagaaagggccaggagatgaattc

SEQ ID NO: 131 - DNA, 509 bp, Homo sapiens
tttttttttttttttcccatttaagcactgcaagtatttatttttacagattctattgttctttggggaaaatatcatgaaatgaagattcattaggaaaagggtaacatagtgaaaaagttccaggggcagaggcctaaaaaagtcattcaaagcactgcagggagctgtttagcaaatgctgtgtccaaagcagcagcccaatactcagcttctgcctggagttccaagcaaaactggggaagctctgtgccagaaaatacactttttcaagataagtgagaaatacagatttttatgtgacagttactgatgtttaaagttggcaattacttcaaatatgatttttacaaacattatgtaggccaaatttggccctttggttaaaaacccttgtgaaaagtattttagataaaaaaaaatcttgttttcctcctaaaaaccttttatagaaaagaaagctaagtggtctggcacctgctaagtgccaggcatggttctatatgcta

SEQ ID NO: 132 - DNA, 5389 bp, Homo sapiens
gcggccgcgcaagtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaaatcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacacaaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcacctgatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatattgatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcag

SEQ ID NO: 133 - DNA, 2114 bp, Homo sapiens
ttggaagtgcagaccatggattcctatgcagcagatgggggttgtctgtttgtgcacttttttcctaagctgctgaaattcctccgatgtgaatgggccatagtaatctttgcctcctgcgtgactgtaagcatggcctccagtggatcagagaaagcagctcagtgattgttctcatggccaaaaataaagcacaagggttaccggaattgaatgagccctgttcagggcagcacggggcatctgcaccccagctgggcagcatgatccttgtattcaactatactcttctggcagtagttggtggcaagcattcgcgtgcctctgtcacaaccatacgtagaaacacattaggtatgtctggaaagctacaaatcccacatccaagcacagtaccgtctgcttcatctgattaacacacacacaagaaagaaaaattacacccacagaaaactgagtatgtattgtagaaatgtagaggaaaaataaaaatatttttttcaaatgtaattacttttaatatatgcttgtggaaggtctaatacaatgtatgctgtctctgtaatttttgctgtaaataactggagacggtgagtacactgatttttctatgtctctgtttaagcataagactttgtaacaatttttttagagggggaaaatcaacaaagagcaaatatgtacttgcttcctttctgcgtgttatgtacttctcagttttttaatggaaactggttgtaacagtttaagcatcttgacgggtcattggtgttaagtgtatgcttctttttgtaatatgactgagaaagggacagggctgtcaattaaatctgctccaaagaatttgtattgaagattggcctaagacctgcaaactccatctataactagaaaatacgaaaaaggaaaattaaaaaaaaaagttgcctgagttaagtcatctttccttgtagcaaatggctttgtccaaatcctttctgcatggaatagcttaaggaaaacaaactccgctttttgatgaacaagatatttttgtacacatttatttcttgttaataacctgaggtcagaccactcatttgctgaagccataactgaccttcaccaaataaatgttgtaaagaacctaggggagggttggggagagactgagagggaggaaaatccaaggtgtcatgagctatagcaacacaggcaggagcaagttgttgaaactgatgcttttcctgcatcccaaatatgactttaaaaggctagtattttatgatgatcgatttataatgataaaaagatatttagatttaaatgagacattccaatatttttgaaatccctaacaatgcttccttgcttttaggattgagagaaatgattttcatatacttccaacattcagagatttaatgtttttaccttagctccagcctacgcttgtaaagtgaagagtgattctaagtcccgtgaaaccgtgggctgcctggggcttggctgtgcccactaacctactgcgcctggggggcagcatgggaggggtacagtttgcatctcattagcatgcacaccactgttggcaatgcataaaagttgcattgccacaagtatgtaaaataaaaatattcactctaaaaagaataataattctacttttttaaaagaataatgtctcttatagtcaccattgatttttctggagtttaattacattattaccatgtattcttattggcctgtagaggaaaaaggcaaaccacaaataaacccagtgacatatatagttttaaaatctacaattttctgatctctctctccttgtttaatatataagccctaatttctgtgtatgtgagtaaaactgcagcctgagtcatttaggaagtaagtattgagtttttttaatcataaatatactagaataaaacagcactccctaacaattaaaaaagagttttatattactttagaatgtaataggtttttgtccttattttatgtcctgtaaattattagttcaatactgttagcattcccggataatgcacacatgatttctgaatgttttctgtaaatgacaatcaatgtttatgaagttccctcctttaatgctgaacaaaatt

SEQ ID NO: 134 - DNA, 987 bp, Homo sapiens
ttggactatgaacagtcgtgtttaagcaggctggtccggtccggaatcccgggatatcgtcgacccacgcgtccggacaacccagaatctgatcaccaggacataggaatggccccatcagatttcttgagccatttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgtttttttttctttctctttggcttttgcttttgctctctctcacttctttcttattttgttgcattggtagagtgttgtatggctagcattgtattgtatgtaattcaattttgcacaaacatttagcatagtaggttaatttggtggtttttatgaccatgccaaaataatattctgggctggtggagataaaggactgttctttaggactgaaacttgattttgctcatagtaagtaaaaaaaaacaaaaaacacacacactcacagatgtgtatcgtaagtgtcataagcactgcgatattaatgggtatcttctatcacttctgactaatgtgaaaactgttgtacgaaaactacctgaacaaagtcatctgttacgactcgtgtgggcttgccttcacagttgccggatttgagtcattctcatgtctcggtaatttccattaatttatgccaaatacatgtgtgattaaacacttggtttaagctccagctctgcctcagaactggggttcaatatacttttagccatggtcttcaaaatgaac

SEQ ID NO: 135 - DNA, 1032 bp, Homo sapiens
ctatgtactatagaacaagtttgttcaaaaagcaggctggtaccggtccggaattcccgggatatcgtcgacccacgcgtccgccgatgctttgctacgctaggctggaaaatgcctccctctgcccttgagaagggggtctgaatgtttgcgggactgacaccgcagcaacatgccggtgtgtttcacgctgctgcctcctgtttcccttgaagctttcaccagaccctggatttctttttcacttcctgttctgagccatcgccgggcactcattacccaccagctgtgtcccagctgccgcattctacactagaggtggcgccctgcacccggcggaaatgaagagaatcagactacccaccttggattctgatatgaaagatttaggataaaagagctactccatcagcctggaaagatgactcactggcaaactcttagataaagctaaacttcacaccaaactgcaagagagtctaagaatgaagagaaaactgctttggcaagcaactacctagtctctgacacagtccaccttttggtcagccaatatccagctccgccttgtcttcttacacaaagcccaggcaaagcccaggattgctaactgttgtacaaacctgttggtcaggcctagatggaagctttcaaccccatttcaagtcagctggcttatccaaccctgaaaggtctgtgatctctcagattctttttataaacagggcctctgcttgcaaaatggccaattcttgcctgagctcatctctttctgtaatactttatgaaaggcaggacagtagtactatgcataaatttgtccaaccaactggcccaaggtcagtagaccttttaccaatgtttcgcatgtttagctgaatctccatcttctcctccgtatcaaggtcctcagggccaccatattgtaggcttactaattttttttgggaacattttcgggaaatttggggggcaagcctatgtgaaaggagaacattttctataaaggctcagaataaggccgaaatcccg

SEQ ID NO: 136 - DNA, 451 bp, Homo sapiens
ttttttttttttgtttcattttttattttttgcagttcaagtgatgctaagaaggaagatcatcataggcaaagggaccagctaacagcaaggacctgggcaagttcaagaagcagaaaatgttccaaaggaaatgtgatatagttggtgggacaagagtggcgccaaaggaggctggaaatgcaggttacaaccagttaacagagaagcttgtaatccatggtaaagagtttagactctattttaaacccaacagaaaatcactaggggagttttaagcagggagcgtattgagtagaccgaggaacaaatgataaaaatagaaaaaaaaatagtgtcttcaaactgttttacacagtttagggcatttgctacagtacagaaataattccagaagaaaatgttgccataagaaaaaaattaaggtaaaaggcattgacataatggttgg

SEQ ID NO: 137 - DNA, 430 bp, Homo sapiens
gacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggagaataaagttacccttgtactgca

SEQ ID NO: 138 - DNA, 4646 bp, Homo sapiens
cctactctattcagatattctccagattcctaaagattagagatcatttctcattctcctaggagtactcacttcaggaagcaaccagataaaagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagcgcttcgctctctttgccacaggaagcctgagctcattcgagtagcggctcttccaagctcaaagaagcagaggccgctgttcgtttcctttaggtctttccactaaagtcggagtatcttcttccaagatttcacgtcttggtggccgttccaaggagcgcgaggtcgggatggatcttgaaggggaccgcaatggaggagcaaagaagaagaacttttttaaactgaacaataaaagtgaaaaagataagaaggaaaagaaaccaactgtcagtgtattttcaatgtttcgctattcaaattggcttgacaagttgtatatggtggtgggaactttggctgccatcatccatggggctggacttcctctcatgatgctggtgtttggagaaatgacagatatctttgcaaatgcaggaaatttagaagatctgatgtcaaacatcactaatagaagtgatatcaatgatacagggttcttcatgaatctggaggaagacatgaccaggtatgcctattattacagtggaattggtgctggggtgctggttgctgcttacattcaggtttcattttggtgcctggcagctggaagacaaatacacaaaattagaaaacagttttttcatgctataatgcgacaggagataggctggtttgatgtgcacgatgttggggagcttaacacccgacttacagatgatgtctctaagattaatgaagttattggtgacaaaattggaatgttctttcagtcaatggcaacatttttcactgggtttatagtaggatttacacgtggttggaagctaacccttgtgattttggccatcagtcctgttcttggactgtcagctgctgtctgggcaaagatactatcttcatttactgataaagaactcttagcgtatgcaaaagctggagcagtagctgaagaggtcttggcagcaattagaactgtgattgcatttggaggacaaaagaaagaacttgaaaggtacaacaaaaatttagaagaagctaaaagaattgggataaagaaagctattacagccaatatttctataggtgctgctttcctgctgatctatgcatcttatgctctggccttctggtatgggaccaccttggtcctctcaggggaatattctattggacaagtactcactgtattcttttctgtattaattggggcttttagtgttggacaggcatctccaagcattgaagcatttgcaaatgcaagaggagcagcttatgaaatcttcaagataattgataataagccaagtattgacagctattcgaagagtgggcacaaaccagataatattaagggaaatttggaattcagaaatgttcacttcagttacccatctcgaaaagaagttaagatcttgaagggcctgaacctgaaggtgcagagtgggcagacggtggccctggttggaaacagtggctgtgggaagagcacaacagtccagctgatgcagaggctctatgaccccacagaggggatggtcagtgttgatggacaggatattaggaccataaatgtaaggtttctacgggaaatcattggtgtggtgagtcaggaacctgtattgtttgccaccacgatagctgaaaacattcgctatggccgtgaaaatgtcaccatggatgagattgagaaagctgtcaaggaagccaatgcctatgactttatcatgaaactgcctcataaatttgacaccctggttggagagagaggggcccagttgagtggtgggcagaagcagaggatcgccattgcacgtgccctggttcgcaaccccaagatcctcctgctggatgaggccacgtcagccttggacacagaaagcgaagcagtggttcaggtggctctggataaggccagaaaaggtcggaccaccattgtgatagctcatcgtttgtctacagttcgtaatgctgacgtcatcgctggtttcgatgatggagtcattgtggagaaaggaaatcatgatgaactcatgaaagagaaaggcatttacttcaaacttgtcacaatgcagacagcaggaaatgaagttgaattagaaaatgcagctgatgaatccaaaagtgaaattgatgccttggaaatgtcttcaaatgattcaagatccagtctaataagaaaaagatcaactcgtaggagtgtccgtggatcacaagcccaagacagaaagcttagtaccaaagaggctctggatgaaagtatacctccagtttccttttggaggattatgaagctaaatttaactgaatggccttattttgttgttggtgtattttgtgccattataaatggaggcctgcaaccagcatttgcaataatattttcaaagattataggggtttttacaagaattgatgatcctgaaacaaaacgacagaatagtaacttgttttcactattgtttctagcccttggaattatttcttttattacatttttccttcagggtttcacatttggcaaagctggagagatcctcaccaagcggctccgatacatggttttccgatccatgctcagacaggatgtgagttggtttgatgaccctaaaaacaccactggagcattgactaccaggctcgccaatgatgctgctcaagttaaaggggctataggttccaggcttgctgtaattacccagaatatagcaaatcttgggacaggaataattatatccttcatctatggttggcaactaacactgttactcttagcaattgtacccatcattgcaatagcaggagttgttgaaatgaaaatgttgtctggacaagcactgaaagataagaaagaactagaaggtgctgggaagatcgctactgaagcaatagaaaacttccgaaccgttgtttctttgactcaggagcagaagtttgaacatatgtatgctcagagtttgcaggtaccatacagaaactctttgaggaaagcacacatctttggaattacattttccttcacccaggcaatgatgtatttttcctatgctggatgtttccggtttggagcctacttggtggcacataaactcatgagctttgaggatgttctgttagtattttcagctgttgtctttggtgccatggccgtggggcaagtcagttcatttgctcctgactatgccaaagccaaaatatcagcagcccacatcatcatgatcattgaaaaaacccctttgattgacagctacagcacggaaggcctaatgccgaacacattggaaggaaatgtcacatttggtgaagttgtattcaactatcccacccgaccggacatcccagtgcttcagggactgagcctggaggtgaagaagggccagacgctggctctggtgggcagcagtggctgtgggaagagcacagtggtccagctcctggagcggttctacgaccccttggcagggaaagtgctgcttgatggcaaagaaataaagcgactgaatgttcagtggctccgagcacacctgggcatcgtgtcccaggagcccatcctgtttgactgcagcattgctgagaacattgcctatggagacaacagccgggtggtgtcacaggaagagatcgtgagggcagcaaaggaggccaacatacatgccttcatcgagtcactgcctaataaatatagcactaaagtaggagacaaaggaactcagctctctggtggccagaaacaacgcattgccatagctcgtgcccttgttagacagcctcatattttgcttttggatgaagccacgtcagctctggatacagaaagtgaaaaggttgtccaagaagccctggacaaagccagagaaggccgcacctgcattgtgattgctcaccgcctgtccaccatccagaatgcagacttaatagtggtgtttcagaatggcagagtcaaggagcatggcacgcatcagcagctgctggcacagaaaggcatctatttttcaatggtcagtgtccaggctggaacaaagcgccagtgaactctgactgtatgagatgttaaatactttttaatatttgtttagatatgacatttattcaaagttaaaagcaaacacttacagaattatgaagaggtatctgtttaacatttcctcagtcaagttcagagtcttcagagacttcgtaattaaaggaacagagtgagagacatcatcaagtggagagaaatcatagtttaaactgcattataaattttataacagaattaaagtagattttaaaagataaaatgtgtaattttgtttatattttcccatttggactgtaactgactgccttgctaaaagattatagaagtagcaaaaagtattgaaatgtttgcataaagtgtctataataaaactaaactttcatgtg

SEQ ID NO: 139 - DNA, 411 bp, Homo sapiens
  misc_feature (391)..(391): n is a, c, g, or t
cttatctattattatgtttattagtaaagttaggcattaaaaagtgacagctttcaaaatattgctgcttcatttagtgttatatcatattttatattccaagtagctttgaattttatgaatgcttttcaatacagcaagcatattttatatatactagtagcaccatggcattgagaatttgcaataattcaaaaatataagtattccttgcctaaatatatttggtatccatcacaagtaaggcagaaggttaagtgaaaaagaatagaaatggggttcttcactttaagactgcatttcattaatacaaacatctttagtacagataaaaatgaggctagccaaagaaaatttctttttaagatggaatatgtatttactgatgctntatgaaaaatgtaaagttac

SEQ ID NO: 140 - DNA, 3213 bp, Homo sapiens
agagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgttttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggttcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggttcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggttctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaa

SEQ ID NO: 141 - DNA, 6202 bp, Homo sapiens
agggagagagggcggggttattggaagaagaaaaagaaaaaaagaactagataaaggagggcacatccctctcactcccgcctttccccttacctttctgtctctcgggacccttatttcttcgtcacggtgtccaggaccattttgaccctgtcggccccggcacccccccgccgcaccccagccccgagcatggggacggcgctgctccagcgcgggggctgttttcttctgtgcctctcgctgctgctcctgggctgctgggcggagctgggcagcgggctggagtttccgggcgccgagggccaatggacgcgcttccccaagtggaacgcctgctgcgagagcgagatgagcttccagctcaagactcgcagcgcccgcggcctcgtgctctacttcgacgacgagggcttctgcgacttcctggagctgattctgacgcgcggcggccgcctgcagctcagcttctccatcttctgcgctgagcctgcgacgctcctggccgacacgccggttaacgacggcgcctggcacagcgtgcgcatccgccgccagttccgcaacaccacgctcttcatcgaccaggtggaggccaagtgggtggaggtcaagtccaagcgcagggacatgacggtgttcagcggccttttcgtcggggggctgcccccggaactgcgcgccgcggcgctcaagctcaccctggcctcggtgagggagcgggagcccttcaaggggtggattcgtgacgtgagggtcaactcctcgcaggtcctgcccgtggacagcggcgaggtgaagctggacgatgagccgcccaacagcggcgggggaagcccgtgcgaggcgggcgaggagggcgagggcggggtgtgcctcaacggaggtgtgtgctccgtggtggacgaccaggccgtgtgcgactgctcgcgaaccggcttccgcggcaaggactgcagccaagaagacaacaatgtggaaggtctggcgcacctgatgatgggcgaccaaggtaaaagtaaaggaaaagaagaatatattgccacgttcaaaggatctgaatacttctgctacgacttgtctcaaaaccccattcaaagcagcagtgatgaaataactctgtcatttaaaacccttcagaggaatggactgatgcttcacactgggaaatcggctgattatgtcaatcttgccctgaaaaatggagctgtctctctggtcattaatttgggatcaggggcctttgaagcactagtggagcctgtgaatggaaagtttaatgataatgcctggcatgatgtgaaagtcaccaggaatctgcgtcagcactcaggcattggacacgctatggtgacaatatcagtggatgggattcttaccacaacgggctacacgcaagaagattataccatgctggggtctgatgactttttctatgttggaggcagtcccagcacagccgaccttccagggtcaccagtcagtaacaactttatgggctgtctcaaagaggttgtatataaaaataatgatgtgaggctggaattatctcgacttgccaagcaaggagatcctaagatgaagatccatggagtggtggcatttaaatgtgagaatgttgcaactttagacccaatcacctttgaaaccccagagtctttcatctctttgcctaaatggaatgcaaagaaaactggctccatatcatttgatttccgtacaacagagccaaatggcctcatcttatttagccatggcaagccaagacatcagaaagatgccaagcacccacagatgataaaggtggacttctttgctattgagatgctagatggccacctctacctcctcctggacatggggtcaggtactataaaaataaaagccctgttgaagaaagtgaatgatggagaatggtatcatgtggacttccagagagacggacggtcaggtaccatttctgtcaacacgttgcgtactccctacactgctcctggtgagagtgagattctggacctggatgatgagttgtacctgggggggctgccagaaaataaagctggccttgtcttccccaccgaggtgtggactgctctgctcaactatggctacgtgggctgcatcagggatttgttcatcgatggccaaagcaaagatatccggcaaatggctgaagttcaaagtactgctggagtgaagccttcctgctcaaaggaaacagcaaaaccgtgccttagcaacccttgcaaaaacaatggcatgtgcagggatgggtggaacagatatgtctgtgattgttccggaacaggctatcttggcaggtcctgtgagagagaggcaacggttttgagctatgatgggagcatgtttatgaaaattcagctccccgtagtcatgcatacggaggctgaggatgtttccttacggttccgatcccagcgtgcatatggcattctgatggcaaccacttctagagactctgctgacaccctccgcctggagctagacgcaggacgtgtgaaactgacggtcaatctagattgtatcaggattaactgtaattccagcaaaggtcccgagactctttttgctggctataacctcaatgataacgagtggcacacagtgcgtgtagttcggcgtggaaaaagtttaaagttaacagtggatgaccaacaggccatgacaggtcaaatggcaggtgatcatactaggctggagttccataacatagagactggcatcatcacagaacgacggtatctttcttctgtcccctccaacttcattggacacctgcagagcttgacatttaatggaatggcatacattgacctgtgtaaaaatggcgacatagattactgtgagcttaatgccagatttggcttcaggaacatcatagcagatcctgtcaccttcaagaccaaatcgagctatgttgccttagctaccttgcaagcctacacttctatgcatctttttttccagttcaagacaacatccctagatggattaattctatataacagtggggatggaaatgactttattgtggttgaattagttaaagggtacttacattacgtgtttgatttgggaaatggtgctaacctcatcaaaggaagctcaaataaacctctcaatgacaatcagtggcacaacgtgatgatatcaagggacaccagcaacctccacactgtaaagattgacacaaaaatcacaacgcaaatcaccgccggagccaggaacttagacctcaagagtgacttatatataggaggagtagctaaagaaacatacaaatccttaccaaaacttgtacatgccaaagaaggctttcaaggctgcctggcatcagttgatttaaatggacggcttccggacctcatctccgatgctcttttctgcaacggacagatcgagagaggatgtgaagggcccagcacaacctgccaagaggactcatgttccaatcaaggtgtgtgcttgcaacaatgggatggcttcagctgtgactgtagtatgacttccttcagtggaccactctgcaatgaccctgggacgacatatatctttagcaaaggtggtggacaaatcacgtataagtggcctcctaatgaccgacccagtacgcgagcagacagactggccataggttttagcactgttcagaaagaagctgtattggtgcgagtggacagttcttcaggcttgggtgactacctagaactgcatatacaccagggaaaaattggagttaagtttaatgttgggacagatgacatcgccattgaagaatccaatgcaatcattaatgatgggaaataccatgtagttcgtttcacgaggagtggtggcaatgccacgttgcaggtggacagctggccagtgatcgagcgctaccctgcagggcgtcagctcacaatcttcaatagccaagcaaccataataattggcgggaaagagcagggccagcccttccagggccagctctctgggctgtactacaatggcttgaaagttctgaatatggcagccgaaaacgatgccaacatcgccatagtgggaaatgtgagactggttggtgaagtgccttcctctatgacaactgagtcaacagccactgccatgcaatcagagatgtccacatcaattatggagactaccacgaccctggctactagcacagccagaagaggaaagcccccgacaaaagaacccattagccagaccacagatgacatccttgtggcctcagcagagtgtcccagcgatgatgaggacattgacccctgtgagccgagctcaggtgggttagccaacccaacccgagcaggcggcagagagccgtatccaggctcagcagaagtgatccgggagtccagcagcaccacgggtatggtcgttgggatagtagccgctgccgccctgtgcatccttatcctcctctatgccatgtacaagtacagaaaccgggatgaaggctcataccatgtggacgagagtcgaaactacatcagtaactcagcacagtccaatggggctgttgtaaaggagaaacaacccagcagtgcgaaaagctccaacaaaaataagaaaaacaaggataaagagtattatgtctgatcccaagatcttaaatggacacttgtatagaaatagtcttcattttatctgagacataatataaacttatttactttcctttttatgaagcacatacaaaagaagacagagaatgcaatcaggaaggaaagactttttaaaaaataaaaacaagtatctcatgctcttgtttctcaaaaaagaaaaacaaaaaacaaaaaacaggggccaataaattccctaacatccacagtgttttcatttactctgcttgtctttatgttgctggaacatttctaaaagacagtgatgaccgcacgcattcataaagcaaaggagtactacagcatcaaggcacaacacaaaaaccaacacaaaacataacacaaaaaagaagctacctatgatcctggatttagccaaagtgctagcgctttcctgagaagtcagtccaattgccagagaagactgtccttttgagtgactcaacctgcaaacctttaagagtttgccgcctggtgcaactggagcagtggttggaacttgcatttgaaacaaagtgctggcttttttgaagacttgtgtaggaacacattcaaaaagcccctttctggttgtgagagaggaaaaaaaagtatggaggccttattttcaaaaatgtgaaatataaggcacgttttcacacaaaatttcaaaacaaaaacaagagggcatagatgcaatcattgggaaattttcatgcacgcttattatgttattacatatgtttatataaaatccatctctgtgtgctttctggactgtgataagtgacgttttatagcctgttgtatagaaaatgcaaaatatatctctgctcttcagccatttttggtaaattcaatgttataagtgttgctaagtatagggagttttatgacatcagagcaacaattatttcagttgggtttttctttttttttgccaccattataaattgccacaattacttttattttttaaagaaattacagtgtagtgtttattctaaggaagatatgtatgaatgtatatacaaagactcagctacttcttttcttatatgtacagccttcattctgttgcaattaagttttagtacttgtatgaaaggtgtgaattagaaagtcacatatatacatatgtatcttataatcttttctccctgaaatactcacattcccacatacattcactattttcacacacacacacacacacacacacacacgaatccacagcaatccatcagatatgctggaagatccaaacgtgcatacagtagcaaatatttattgacaaattgaaaagcaggaaggaagagggttgtgccaaggtattgatgacaaatggggtgatttgcttcattgagatcttgctcccaggtaaccttaagaagattttagtccctaaagaaatgaacctttccttatcaaatagaatatcactgatatactgctgcatgaataagaaccattatgtgggcaggttatggaagcaaaattggttaatctacaccttaactctggctgctgcaattgaaaactttctttctaataaaataatatatatatctctg

SEQ ID NO: 142 - DNA, 3455 bp, Homo sapiens
gcggagcgagggaaacggactcggcggcgccggcatgaggagctgagcgtctcgggcgaggcgggctgacggcagcaccatgcaggcggcagtggctgtgtccgtgcccttcttgctgctctgtgtcctggggacctgccctccggcgcgctgcggccaggcaggagacgcctcattgatggagctagagaagaggaaggaaaaccgcttcgtggagcgccagagcatcgtgccactgcgcctcatctaccgctcgggcggcgaagacgaaagtcggcacgacgcgctcgacacgcgggtgcggggcgacctcggtggcccgcagttgactcatgttgaccaagcaagcttccaggttgatgcctttggaacgtcattcattctcgatgtcgtgctaaatcatgatttgctgtcctctgaatacatagagagacacattgaacatggaggcaagactgtggaagttaaaggaggagagcactgttactaccagggccatatccgaggaaaccctgactcatttgttgcattgtcaacatgccacggacttcatgggatgttctatgacgggaaccacacatatctcattgagccagaagaaaatgacactactcaagaggatttccattttcattcagtttacaaatccagactgtttgaattttccttggatgatcttccatctgaatttcagcaagtaaacattactccatcaaaatttattttgaagccaagaccaaaaaggagtaaacggcagcttcgtcgatatcctcgtaatgtagaagaagaaaccaaatacattgaactgatgattgtgaatgatcaccttatgtttaaaaaacatcggctttccgttgtacataccaatacctatgcgaaatctgtggtgaacatggcagatttaatatataaagaccaacttaagaccaggatagtattggttgctatggaaacctgggcgactgacaacaagtttgccatatctgaaaatccattgatcaccctacgtgagtttatgaaatacaggagggattttatcaaagagaaaagtgatgcagttcaccttttttcgggaagtcaatttgagagtagccggagcggggcagcttatattggtgggatttgctcgttgctgaaaggaggaggcgtgaatgaatttgggaaaactgatttaatggctgttacacttgcccagtcattagcccataatattggtattatctcagacaaaagaaagttagcaagtggtgaatgtaaatgcgaggacacgtggtccgggtgcataatgggagacactggctattatcttcctaaaaagttcacccagtgtaatattgaagagtatcatgacttcctgaatagtggaggtggtgcctgccttttcaacaaaccttctaagcttcttgatcctcctgagtgtggcaatggcttcattgaaactggagaggagtgtgattgtggaaccccggccgaatgtgtccttgaaggagcagagtgttgtaagaaatgcaccttgactcaagactctcaatgcagtgacggtctttgctgtaaaaagtgcaagtttcagcctatgggcactgtgtgccgagaagcagtaaatgattgtgatattcgtgaaacgtgctcaggaaattcaagccagtgtgcccctaatattcataaaatggatggatattcatgtgatggtgttcagggaatttgctttggaggaagatgcaaaaccagagatagacaatgcaaatacatttgggggcaaaaggtgacagcatcagacaaatattgctatgagaaactgaatattgaagggacggagaagggtaactgtgggaaagacaaagacacatggatacagtgcaacaaacgggatgtgctttgtggttaccttttgtgtaccaatattggcaatatcccaaggcttggagaactcgatggtgaaatcacatctactttagttgtgcagcaaggaagaacattaaactgcagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtttgcagtaatgagctgaagtgtgtgtgtaacagacactggataggttctgattgcaacacttacttccctcacaatgatgatgcaaagactggtatcactctgtctggcaatggtgttgctggcaccaatatcataataggcataattgctggcaccattttagtgctggccctcatattaggaataactgcgtggggttataaaaactatcgagaacagagacagttaccccagggagattatgtaaaaaagcctggagatggtgactctttttatagcgacattcctcccggagtcagcacaaactcagcatctagttctaagaagaggtcaaatgggctctctcattcttggagtgaaaggattccagacacaaaacatatttcagacatctgtgaaaatgggcgacctcgaagtaactcttggcaaggtaacctgggaggcaacaaaaagaaaatcagaggcaaaagatttagacctcggtctaattcaactgagactttatctcctgccaagtctccttcttcatcaactgggtctattgcctccagcagaaaatacccttacccaatgcctccacttcctgatgaggacaagaaagtgaaccgacaaagtgccaggctatgggagacatccatttaagatcaactgtttacatgtgatacatcgaaaactgtttacttcaacttttatagaaacccaggctcatggaatcactgcaaatctatctgctcttcagacaatacgaagaccctctgagatgctacagaggagaggaagcggagtttcacatctggttaccattttctttttgtcattggcttaggatttaactaaccatgaaaagaactactgaaatattacactataacatggaacaataaaggtactggtatgttaatggataatccgcatgacagataatatgtagaaatattcataaagttaactcacatgacccaaatgtagcaagtttcctaaggtacaatagtggattcagaacttgacgttctgaggcacatcctcactgtaaacagtaatgctatatgcatgaagcttctgtttattgttttccatatttaaggaaacaacatcccataatagaaatgagcatgcagggctaaggcatataggatttttctgcaggactttaaagctttgaaaggccaatatcccataggctaactttaaacatgtatttttatttttgttttgttttttacttttcatatttatattagcatacaaggacaattgtatatatgtaacatttttaaaattttaaaaaaaaaaaaaa

SEQ ID NO: 143 - DNA, 1001 bp, Homo sapiens
ctggccgaaaacaaacaatcactgagaagtctcaaagaaatataccacgtgaggggaaaaaactgggagaagatccggaatattatcgtttttcctatggtaaaaccggtgcccctcttcaggagaactgatttcaaattattattatgcaaccacaaggatctcttctttctcagggtgtctaagctgctggattgcttttcgcccaaatcaatgtggtttctttggaacattttcagcaaaggaacgcatatgctgcagtgtctttgtggcaagagtcttaagaaaaacaagaacccaactgatccccagctcaagggtatagtgaccaggttatattgcaggcaaggctactacttgcaaatgcaccccgatggagctctcgatggaaccaaggatgacagcactaattctacactcttcaacctcataccagtgggactacgtgttgttgccatccagggagtgaaaacagggttgtatatagccatgaatggagaaggttacctctacccatcagaactttttacccctgaatgcaagtttaaagaatctgtttttgaaaattattatgtaatctactcatccatgttgtacagacaacaggaatctggtagagcctggtttttgggattaaataaggaagggcaagctatgaaagggaacagagtaaagaaaaccaaaccagcagctcattttctacccaagccattggaagttgccatgtaccgagaaccatctttgcatgatgttggggaaacggtcccgaagcctggggtgacgccaagtaaaagcacaagtgcgtctgcaataatgaatggaggcaaaccagtcaacaagagtaagacaacatagccagatcctcacaggtgttgtgacttattcgtcctgagcacagttgagtgatttatcctcaccagacattcctgctccgtggctgaagagcagcaggaagtaagctaatgcttattctttgctgtctccgaacttctctgttgcaa

SEQ ID NO: 144 - DNA, 3533 bp, Homo sapiens
ggcctgagctctcctggcccctggctctcttctgcagagggcctgctctcagctgccacaagagggcgccggagaacggacctgagcaagagaggcaggagctcctctgcaggtcctcccaggcaccaatccttctgggagggaggaaggcttgggagtcctcttagacagatcctcagtcacttctctctgcttgtgtctcaggaagaccagctcctcctactgtcttctgtgctagggatcacttccttgttgagtggggcctgagttttaagaggatcttctgctcctcttcatctggtccctttccttccaaggcctcagagaggaaggcatgcagtgggccctagcggtgcttctagctttcctgtctcctgccagtcagaaatcttccaacttggaagggagaacgaagtcagtcatcaggcagactgggtcatctgctgaaatcacttgtgatcttgctgaaggaagtaccggctacatccactggtacctacaccaggaggggaaggccccacagcgtcttctgtactatgactcctacacctccagcgttgtgttggaatcaggaatcagcccagggaagtatgatacttatggaagcacaaggaagaacttgagaatgatactgcgaaatcttattgaaaatgactctggagtctattactgtgccacctgggaagggacactggttggttcaagatatttgctgaagggactaagctcatagtaacttcacctgataaacaacttgatgcagatgtttcccccaagcccactatttttcttccttcaattgctgaaacaaagctccagaaggctggaacatacctttgtcttcttgagaaatttttccctgatgttattaagatacattgggaagaaaagaagagcaacacgattctgggatcccaggaggggaacaccatgaagactaatgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacacgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttcttatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagttgacttttgtccatggtattttaattggatgacatcaaattgaacatccaaggtaagaaacagcatggcaattgggctgtggaattctgtattggttgtaagaatggtccaacaccccatttctaattctttccctgagatcgtggttatcacaccttctaagaagaactacaaccaaatgaaggagctcatgtgacttctgtttgaaaggtcaccagagtcagattcattcggtttaggacattccagtggctataggacactatctactgtgacgcgtaccgtgtgagctcagctctagagtgtttcacagacactgtgtttcctgatcctcacgatacccccatgagagctgccctaaaagcagagaggcagcgtgatggagaggttcagcacatgctctctgatcccaggaatcctgggtatggtgtttcgtatctgtgtgacctcaggtgagttccaggaactctatgtgccataatctcctcatgtaaaatgaagttataatgccccgtttcctggagttatgtggattagatgagttaatgacacctggcacatgcaagtcctccacagtgtcggcacgcactgttggtagctctactctagagacagtaataaaccaaaaagtatctgacacaggcctcaatcaacttagaagtttattttgcctatgttaagggcatgcccaacttcctgagataataatttatttcataagaatattttaaaaactcgagtaaacttgttaatgtttattgctgcagccactctgtccatctccaccatcactgcaacaacgcaggtccttgttgcctcttattggcttatggtgaccacctataaaaccatctgcttcacccaaattgctgtcctggggagtgccccttcctttctgcttgcacatttatcttcctcaagtgcaaatgtgatcatgtgactttcctccctaaatctttcagcaagtcctcattgtctattcttctttcaaaaacatttatttgaaaatactattaaaatagaaaattttccacattcttacttcttaaaaattaatgtgttttaagtttctcctactccatttccatcccatgcctctttactcaatggatgcaattattcttctacatgttccttctggccatgtgtagctttgtcattttaattttaatctatttggaccctgtgttatctgggatgaggtagagtgatatttttattttctcaggtaattatttgcctaatgcctgtttccaaataatccaccatttccttacaatttaaaaatgctccagcatgtttttaatagctacacatatttgacacattttctggagaatttctgttttatttgtctatttcattattcttgtatcattatcatattatctcagtagctttgtggcaagtattaagatctactatgccaaatgtctattcactgtaccatttttcagaaaattctttttcaatcatctcatatttattcactcctgtagaatttaaaatcaacttatctagcccaacattaaacctcacaccctagaacaacaacatgtcgtagtaattctgactaaaattgctggaaatttatagatgaatttagggtgtattggcctctttatgatagaagctttttattcatcaatgtatgtttctccatttatttaggttttatgttatgcccttaggaaaactaaatactgtgttcttcatatcattcttgtatttttttggtaaatttaataaaagattttataattcaaaaaaaaaaaaaaaaaaaaaaaaaaaaaaaaaaaaaaaaaaaaaaaaaaaaaaaaaaa

SEQ ID NO: 145 - DNA, 4067 bp, Homo sapiens
agaagagctgctcagttaggacccagagggaaccatggaaaccccagcgcagcttctcttcctcctactactctggctcccagagacttccggggaatttgtgttgacgcagtctccaggcaccctgactttgtctccaggggagacagccaccctctcctgcaggaccagtcagtctgttaggagcgtctacatagcctggtatcaacagaaacctggccaggcccccaggcccgtcatacatggcggctcttccagggccactgacatcccggacaggttcagtggcagtgggtctgggacagaattcactctcaccatcaacagactggagcctgaagattttgcagtctactattgtcagcagtatggtaggtctgtcactttcggcggagggaccaaggttgagatcaaacgtaagtgcactttcctaagtcttcttcttataaggtttttaaatttaggactgaggaatcgagaattagttcatcttaaggaacagtcaagcgctagacagttaagtgaggcatctcaatggtcagattttctctgcatcggtcaggttagtgatattaacagcgaaaagacatttttgttagggggaaagttatgaagttaacactgtggatcatattcggccaagggacacgcctggagatgaaatgtaagcaacctttcagtattgtcttctgaaatttggctctgacggccagtcttgacttccagaggcttgaagaggagtttggtaaatattggtaaatgagggcatttaagatttgccatgggttgcaaaagttcaactcagcttcaaaaatggatttggagaaatatagcttaaattgctctaaactgaatgacacaaagtcaaaaaaaaaaagtgtaactaaaaaggaacccttgtatttctaaggagcaaaagtaaatttatttttgttcactcttgccaaatattgtattggttgttgctgattatgcatgatacagaaaagtgtaaaaatacattttttagtctttctcccttttgtttgataaattattttgtcagacaagtataaaaatcaatagcacgccctaagaaaaatcagggaaaagtgaagtgtacctatttgctatgtagaagaggcagcttacttgaaaatcagcagcaatgttgtttttagagtctgtaataagtaataaagtcaaaaagacacattctataggaataagggcctcacaggtagagctcattttttaaaaatcccatttgtacaatagactaaacgtgaaattatctcttattgtaatggtggaaaggtggttattcccaaaagctcaatctcagagaaatgtgtttaaatgaaaaaaagaaaataaatgcattttttaatgaccgtgggtctgtgaaaaaaataggaaatattttaaagagtatgttctttcattatcctctgttatttcttgtctacatttttattctgtcaagaaggccgtggcaccgcgagctgtagacagagccgcggtctttctcgattgagtggctttggtggccatgccaccgcgctcttggggcagccgccttgccgcaagtggccgtggccaccctgtgtctgcccgattaatgctgccgtagccagctttcctgatgcacagtgatacaaataatgccactaagggaaagagaacagaaacgtaatgggcgctgagctgggaaagccagggagaagactgatttattagagatttcagaaataaaattcacattcattatgatatctcattagtgaaaatttccattaggggattgtaaataatttaaagcttttttttttttcagtgctatttaattatttcaatatcctctcatcaaatgtatttaaataacaaaagctcaaccaaaaagaaagaaatatgtaattctttcagagtaaaaatcacacccatgacctggccactgagggcttgatcaattcactttgaatttggcattaaataccattaaggtatattaactgattttaaaataagatatattcgtgaccatgtttttaactttcaaaaatgtagctgccagtgtgtgattttatttcagttgtacaaaatatctaaacctatagcaatgtgattaataaaaacttaaacatattttccagtaccttaattctgtgataggaaaattttaatctgagtattttaatttcataatctctaaaatagtttaatgatttgtcattgtgttgctgtcgtttaccccagctgatctcaaaagtgatatttaaggagattattttggtctgcaacaacttgataggactattttagggcctttttaaagctctattaaaactaacttacaacgattcaaaactgttttaaactatttcaaaatgattttagagccttttgaaaactcttttaaacactttttaaactctattaaaactaataagataacttgaaataattttcatgtcaaatacattaactgtttaatgtttaaatgccagatgaaaaatgtaaagctatcaagaattcacccagataggagtatcttcatagcatgtttttccctgcttattttccagtgatcacattattttgctaccatggttattttatacaattatctgaaaaaaattagttatgaagattaaaagagaagaaaatattaaacataagagattcagtctttcatgttgaactgcttggttaacagtgaagttagttttaaaaaaaaaaaaaaactatttctgttatcagctgacttctccctatctgttgacttctcccagcaaaagattcttattttacattttaactactgctctcccacccaacgggtggaatcccccagagggggatttccaagaggccacctggcagttgctgagggtcagaagtgaagctagccacttcctcttaggcaggtggccaagattacagttgacctctcctggtatggctgaaaattgctgcatatggttacaggccttgaggcctttgggagggcttagagagttgctggaacagtcagaaggtggaggggctgacaccacccaggcgcagaggcagggctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctgagggggtcggatgacgtggccattctttgcctaaagcattgagtttactgcaaggtcagaaaagcatgcaaagccctcagaatggctgcaaagagctccaacaaaacaatttagaactttattaaggaatagggggaagctaggaagaaactcaaaacatcaagattttaaatacgcttcttggtctccttgctataattatctgggataagcatgctgttttctgtctgtccctaacatgccctgtgattatccgcaaacaacacacccaagggcagaactttgttacttaaacaccatcctgtttgcttctttcctcaggaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgc

SEQ ID NO: 146 - DNA, 6263 bp, Homo sapiens
gctaactcaagggagacgtctggtgaacacccgtgggatctaaagaacaagctctgaaagtgttccagctgaaatttcagatcggacagactcgctgcggctccggaggcagtgattccaagctgctcgcgcacgctgctgccaagctgcaggatggtgcacgtagccaggctgctgctgctgctcctcactttcttcctccgcacggatgctgagacacctccaaggtttacacgaacacccgttgatcagacaggggtctctggcggagttgcctctttcatctgccaagctacgggagacccaagacctaaaattgtctggaacaaaaaaggaaagaaagtcagcaatcagagatttgaggtaatagagtttgacgatgggtctggatcagttctcagaatacaacccttacggactccgagggatgaggccatttatgaatgtgtggcctcaaataatgtgggagaaataagtgtatccaccagactcacagttttgcgggaagatcaaattcccaggggcttccctaccattgacatgggcccacagttgaaggtggttgagcgtactcgcacggccaccatgctttgtgcagccagtggtaatccggatccagaaatcacttggtttaaagatttcttacctgtggacacaagcaacaacaatggtcgtattaagcagttacgatcagaatctattggtggtacaccaataagaggagcccttcagattgagcagagtgaagagtctgaccaaggaaaatatgagtgtgttgccaccaacagcgcgggcactcgctattccgctcctgccaatttatatgtcagagagctgcgagaagttcgccgtgtcccaccaagattctctatcccacccactaatcatgaaatcatgccaggcggaagcgttaatatcacctgtgtggccgtggggtcaccaatgccttatgtaaagtggatgttgggggcagaagatctgacacctgaagatgatatgccaataggaagaaatgtgctagaactgaatgatgtaagacagtcagcaaattacacctgtgttgctatgtcaacactgggtgtcattgaagcaatagcacagatcactgtcaaagccttacccaaacctccaggaactcctgtagtgaccgagagcacagctacaagcatcacactgacgtgggactctgggaaccctgagcctgtttcttattacataattcagcataaacctaaaaactctgaggaactttacaaagaaattgatggggtggcgaccacacgctacagtgtcgctggactaagtccctactcggattatgaattcagggttgttgctgtcaataacattgggcgggggcctcccagcgaacctgtgctaacacaaacctcagagcaagcaccatccagtgccccgagggatgtccaggcacgaatgttgagttcgaccaccattttggtacagtggaaggaacctgaagagccaaatggacagatccaaggatatagagtttattatacaatggatcccactcaacatgtcaacaactggatgaaacacaatgtagctgacagccaaatcactactattggcaacttagtgccccagaaaacatattctgtcaaagtcctggcttttacctcaattggagatggtcccctttcaagtgacatacaagtcatcactcagacaggagtaccagggcagccactaaacttcaaagcagaacctgagtctgaaacaagtattttgctctcttggacacctccacgttcagataccattgccaactatgaactggtctacaaagatggggagcatggagaggagcaacgaattaccattgagccagggacatcatataggctgcaaggactgaaaccaaacagcttatactatttccgtctggctgcacgctcccctcaaggcctgggtgcttctactgcagaaatatcagctagaaccatgcagtcaaagccgtcagctcctcctcaagacattagttgcaccagcccaagttccactagtattttggtaagttggcaacctccaccagtggaaaaacagaatggcattatcactgaatactccatcaagtacactgcagtggatggggaagatgacaagcctcacgagattttgggaattccttcggacactaccaaataccttttggaacagctggaaaaatggactgaataccggatcactgtgacagcccatacagatgtcggccctggccctgagagcttgtccgtgttgattcgaaccaatgaagatgttcctagtggtcctcctcgcaaagtcgaggtagaggctgtcaactcaacatctgttaaagtctcatggcgctcacccgtgcccaataaacagcatggccagataagaggatatcaggtgcattatgtgaggatggaaaatggtgagcccaagggccagcccatgctgaaagatgtcatgctggctgatgcacagtgggaatttgatgatactactgaacatgacatgatcatttctgggctccagcctgaaacttcctactccctcaccgtcacagcctacacaaccaaaggagatggtgctcgcagcaagcccaaactggtgtccaccactggggcagttccagggaaacctcggcttgtgattaaccacactcagatgaatactgctcttattcagtggcaccctccggtggacacatttggacctcttcagggctaccgtctaaaatttggccgcaaggatatggagccacttactactcttgagttctctgaaaaagaagatcactttacagctacagacatccacaagggagcatcatacgtcttcaggctctcagccagaaacaaagtgggctttggggaggagatggtgaaggagatttccattccagaagaagtaccaactggattccctcaaaaccttcactcagaaggcaccacttcaacctccgtccagttatcttggcaaccacctgtcctggcagagagaaatggcattatcaccaagtatacccttctttatagggatatcaacatcccccttctcccgatggagcagcttattgttccagctgacaccactatgacactcactggcttaaaaccagataccacatacgatgtaaaagtacgtgctcatacgagcaaagggcccgggccatatagtcccagtgtccagttcaggacactgcctgtggatcaagtgtttgcaaaaaattttcatgtcaaagcagtaatgaagacttccgtgttgctgtcttgggagattccagagaattataactccgccatgcctttcaaaattctttatgatgatgggaaaatggtagaagaagtggatggccgagccacacagaagttaattgtcaacctgaagcctgagaaatcatattcatttgtgctgacaaatcgtggaaacagtgctggtgggctgcagcacagggtcacggcaaagactgcaccagatgtattacgtaccaagcctgccttcattgggaagaccaacttggatggcatgattactgtgcaactgcctgaagtacctgcaaatgagaatataaaaggttactacataataattgtgcctttgaagaaatctcgcgggaaatttatcaagccatgggagagtccagatgaaatggaattagatgagctgcttaaggagatatctaggaagcgcagaagcatccgttatgggagagaagttgaattaaagccatatattgccgctcactttgatgtccttcccactgagttcaccctgggggatgacaagcattatggtggatttacaaacaagcaactccaaagtggtcaagaatatgtcttctttgtgttagcagtaatggaacatgcagagtctaagatgtatgcaaccagcccttactccgaccccgtggtgtcaatggatctggatccgcagccaatcacggatgaagaagaaggcttgatctgggttgtaggtcctgtccttgcagtggtctttatcatctgcattgtcattgctattcttctttataaaaggaagagggcagagtccgactctagaaaaagcagcataccgaacaataaggagatcccttcacaccacccaacagaccctgtagaactgaggcgccttaactttcaaacaccgggtatggctagccatcctccaatacccatcttggaacttgcagaccacattgaaagattgaaagcaaatgacaacttgaagttttcccaggaatatgagtcaattgaccctggccagcagttcacttgggaacattcaaacttggaagtaaacaaaccaaagaatagatacgcgaatgtaatcgcatatgatcattcccgggttctcctatcagctatagaagggatcccaggaagtgactatgtgaatgccaactacatagatgggtataggaagcaaaatgcctatattgcaacacagggatctctccccgaaacatttggggacttttggagaatgatatgggaacaacggagtgccacagttgtcatgatgacaaaactagaagaaagatcaagggtgaagtgtgaccagtattggcctagcagaggcacagaaacccacggactcgttcaagtaacgctgcttgatactgtggagctggccacatattgtgttcgaacatttgcactttacaagaatggttcaagtgagaagagagaagtgagacaattccagttcaccgcctggcctgatcatggtgttccagaacaccctacaccttttctagctttcttacgtagagtcaaaacctgtaaccctcccgatgctggtccgatggttgtgcactgcagtgcgggagttggccggactggttgcttcatcgtcatagatgccatgttagaaagaataaagcatgaaaaaactgtagatatttatggccatgtaactttaatgagagcccagaggaactatatggttcaaacagaagaccaatacatctttatccatgatgcactgttagaagcagtgacttgtggaaataccgaagtgccagctagaaacttgtatgcctacattcagaagctgacacaaatagaaacgggagagaatgtcacaggaatggagctcgaatttaagcgtctagccagctcaaaagctcacacctcaaggtttatcagtgccaatcttccatgtaataaattcaaaaatcgccttgttaatattatgccatatgaatccacaagggtatgcctgcagcctatccgtggagtagaaggatctgattacatcaatgccagttttattgatggatacagacaacagaaagcctacatcgctacccaggggcccttggcagagaccactgaagacttctggcggatgctctgggaacacaattccaccatagttgtgatgctcaccaagctgcgtgaaatgggcagagagaaatgtcaccaatactggccagcagaacggtctgcaagataccagtactttgttgtagatcccatggctgagtacaacatgccacagtatatcctaagggaattcaaggtcacagatgccagggacggccagtcccgaacagtaaggcagttccagttcactgactggccagagcaaggagtgccaaagtccggagaaggatttattgacttcatcggccaagtccataaaacaaaagaacagtttggccaagatggacccatttcagtccattgcagcgcgggcgttggaagaactggagtcttcataacgctaagcattgttttggaaagaatgagatatgaaggagttgtagatatcttccagactgtcaaaatgttaagaacacaacgaccagctatggtacagacagaggatcaatatcagttttcctatcgtgccgcactagagtacctgggcagctttgaccactatgcaacgtagaaacccctgacccattctggatttttactacaggcccttcaatatccatggagtctcttctgagccatacagggcacttgagaagtccttcttaacttctagctaacaactacttagtgggactattacacacaaaacaaattaaaaacaaattattccaggtggaccaagaattctttgacatcgccccttcccaccatactgctcataataacattttaggggccaaggggagggaatgtttaaaaagaaagtccttgatttagttttttagtattgtaaagatactgctgacctgtgcttcatttctaactgtgtaaacttttttttaacaaaatgtatcattcgataaagtgaattttaaaaaagtt

SEQ ID NO: 147 - DNA, 797 bp, Homo sapiens
agcgggttacacaaggggtaccaaagtccactctgagcttttcctctgggaacagatcccagattattccagacttaagacatggagatatatcttgctagaggtaggaagatgataagatcagtttctataggtagaggataatgtgtcctaaaatgtaggtagagataagtctgacagtggtttagacaaaaagggcctctgctaatggtggagagatcaaggaagaaaagagcaacgttaaagtgaggctgtacccacagatcatgctcaagcaaactcgaacagtgagcgcatttctcttaaacaatgaacacttagaataaacaattaaaatttcccacaaatttctaattttaaaatagtttcccaagatttcagtggtattgtatatatgcccatataattttttggattactattcccacaagtgtaagatgaaagaggacctgccctccattctatctactccctctctgcaaaggccattttgaagatctcagttttactgaaaggggtctgccacacataacttccctggtgtaccagcaacaagtgttcagtggaccatggcaacacaaagaatgacggaggagagaaaatgccatgcagaagtgatagtcaagatgaagatgtgggagaggagcagccccagtatatattcagtgtgtcctctgaagtaacaaccatcccatctggctgagaagtgatggacacggtccttatccacactgtaccctctgtcttggcacctctctaacagaaagatttcacaattggctgggatttcgagaacg

SEQ ID NO: 148 - DNA, 1968 bp, Homo sapiens
cgcagggccacagcagctcagccgccggtgccccctcggaaaccatgacccccggcgcgggcccatggagccatggcctatagggtcctgggccgcgcggggccacctcagccgcggagggcgcgcaggctgctcttcgccttcacgctctcgctctcctgcacttacctgtgttacagcttcctgtgctgctgcgacgacctgggtcggagccgcctcctcggcgcgcctcgctgcctccgcggccccagcgcgggcggccagaaacttctccagaagtcccgcccctgtgatccctccgggccgacgcccagcgagcccagcgctcccagcgcgcccgccgccgccgtgcccgcccctcgcctctccggttccaaccactccggctcacccaagctgggtaccaagcggttgccccaagccctcattgtgggcgtgaagaaggggggcacccgggccgtgctggagtttatccgagtacacccggacgtgcgggccttgggcacggaaccccacttctttgacaggaactacggccgcgggctggattggtacaggagcctgatgcccaggaccctcgagagccagatcacgctggagaagacgcccagctactttgtcactcaagaggctcctcgacgcatcttcaacatgtcccgagacaccaagctgatcgtggttgtgcggaaccctgtgacccgtgccatctctgattacacgcagacactctccaagaagcccgacatcccgacctttgagggcctctccttccgcaaccgcaccctgggcctggtggacgtgtcatggaacgccatccgcatcggcatgtacgtgctgcacctggagagctggctgcagtacttcccgctagctcagattcacttcgtcagtggcgagcgactcatcactgacccggccggcgagatggggcgagtccaggacttcctgggcattaagagattcatcacggacaagcacttctatttcaacaagaccaaaggattcccttgcttgaaaaaaacagaatcgagcctcctgcctcgatgcttgggcaaatcaaaagggagaactcatgtacagattgatcctgaagtgatagaccagctccgagaattttatagaccgtataatatcaaattttatgaaaccgttgggcaggacttcaggtgggaataagcccacgaaaggaaagggctctcaagggctcttctgctcatctcttccgtgagatttgctcccagaccctctgatctccctccaacaaaccctggctccagccccctttcccaacttgagttgcatcatcttggaaccaggaagcccagctaaagccaagagaccagagagtccctgccactagttttcatcagtctgttcaagcaaagttgatctgctcctggcacgtccagtaaattccagaatcattctcctttctgcccataaagggccttggagaattgctttaagaagagtgaatgttccaatgatgatagatattataagcgatgatggttctgttgctatgaacacagcagtcggtccctgtcattgtccacccaggagtggccttgttaattccaagtggcatgtatcttccctctgagcttcatttcttcaagatgctctgggtggtgggatgggagaccatcctcagccctcctcagaccttatcaattcattgagagattgcaaagctgaaagcacctccggccactcctgggagacagaccctttggtgatgaaataaaccagtgacttcagagcctatggtctcaactgtgcttgaaaaacactgtctctgaaaacaactttgtgattctccctgctccctgtggacaaaagcacataattctgctgttacgggtactttgctcatacgagctttcatgttcagcatgcaatggaatcatgcttgtccatgtgaaataaatatggctctctcgtgtccttaaaaaaaaaaaaaaaaaa

SEQ ID NO: 149 - DNA, 2673 bp, Homo sapiens
gtgccgcgcccagagcagcagcaacagcgaagatgcgaggccattacctgtttgatccctgtcggaaacctggcacgggccaacttttcccgattatcacgccaagaagttgcaaggactagtcgaagactcggaggggccagggcgagggcgcgctcccccgcgcgctgcctcctccctcctccctccggccgcccgagctcccggcctctctcccgcccgcgctcactccctccgcccgcctccctcctctggccccctccgcgcggcacagggcggggggtgccgcgaaactccgacccgagccacttggacttgcacagtgtccgccgggcgcaggggccgaccgcacgcagtcgcgcagttctgcctccgcctgccagtctcgcccgcgatcccggcccggggctgtggcgtcgactccgacccaggcagccagcagcccgcgcgggagccggaccgccgccggaggagctcggacggcatgctgagccccctccttggctgaagcccgagtgcggagaagcccgggcaaacgcaggctaaggagaccaaagcggcgaagtcgcgagacagcggacaagcagcggaggagaaggaggaggaggcgaacccagagaggggcagcaaaagaagcggtggtggtgggcgtcgtggccatggcggcggctatcgccagctcgctcatccgtcagaagaggcaagcccgcgagcgcgagaaatccaacgcctgcaagtgtgtcagcagccccagcaaaggcaagaccagctgcgacaaaaacaagttaaatgtcttttcccgggtcaaactcttcggctccaagaagaggcgcagaagaagaccagagcctcagcttaagggtatagttaccaagctatacagccgacaaggctaccacttgcagctgcaggcggatggaaccattgatggcaccaaagatgaggacagcacttacactctgtttaacctcatccctgtgggtctgcgagtggtggctatccaaggagttcaaaccaagctgtacttggcaatgaacagtgagggatacttgtacacctcggaacttttcacacctgagtgcaaattcaaagaatcagtgtttgaaaattattatgtgacatattcatcaatgatataccgtcagcagcagtcaggccgagggtggtatctgggtctgaacaaagaaggagagatcatgaaaggcaaccatgtgaagaagaacaagcctgcagctcattttctgcctaaaccactgaaagtggccatgtacaaggagccatcactgcacgatctcacggagttctcccgatctggaagcgggaccccaaccaagagcagaagtgtctctggcgtgctgaacggaggcaaatccatgagccacaatgaatcaacgtagccagtgagggcaaaagaagggctctgtaacagaaccttacctccaggtgctgttgaattcttctagcagtccttcacccaaaagttcaaatttgtcagtgacatttaccaaacaaacaggcagagttcactattctatctgccattagaccttcttatcatccatactaaagccccattatttagattgagcttgtgcataagaatgccaagcattttagtgaactaaatctgagagaaggactgccaaattttctcatgatctcacctatgactttggggatgataatccaaaagtatttcacagcactaatgctgatcaaaatttgctctcccaccaagaaaatgtaaaagaccacaattgttcttcaaaaacaaacaaaacaaaacaaaacaaaattaactgcttaaatgttttgtcggggcaaacaaaattatgtgaattgtgttgttttcttggcttgatgttttctatctacgcttgattcacatgtactcttttctttggcatagtgcaactttatgatttctgaaattcaatggttctattgactttttgcgtcacttaatccaaatcaaccaaattcagggttgaatctgaattggcttctcaggctcaaggtaacagtgttcttgtggtttgaccaattgtttttctttctttttttttttttagatttgtggtattctggtcaagttattgtgctgtactttgtgcgtagaaatgtgagttgtattgtcaaccccagtcagtaaagagaacttcaaaaaattatcctcaagtgtagatttctcttaattccatttgtgtatcatgttaaactattgttgtggcttcttgtgtaaagacaggaactgtggaactgtgatgttgtcttttgtgttgttaaaataagaaatgtcttatctgtatatgtatgagtcttcctgtcattgtatttggcacatgaatattgtgtacaaggaattgttaagactggttttccctcaacaacatatattatacttgctactggaaaagtgtttaagacttagctaggtttccatttagatcttcatatctgttgcatggaagaaagttgggttcttggcatagagttgcatgatatgtaagattttgtgcattcataattgttaaaaatctgtgttccaaaagtggacatagcatgtacaggcagttttctgtcctgtgcacaaaaagtttaaaaaagttgtttaatatttgttgttgtatacccaaatacgcaccgaataaactctttatattcattcaaaga

SEQ ID NO: 150 - DNA, 12515 bp, Homo sapiens
ctaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggctggaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacctagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaatgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacagctgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccagtatgcactgacaagcccacgactcacgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacaccccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaacgtggacgcagaagatgtaattggcagcaggagacagccaagagcacctaaggaaaaggcccaacccctggaagacctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaagataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataacaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgttctccagggcacggtggcaggaacaactatcctcgtctgtcccaacactgagcaggcactcggtaaacacgaatgaatggataagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccagatcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgcgatctggtcccccagcctctcttgggctttcttacactaactctgtacctaccatctcctgcctcccttaggcaggcacctccaaccaccacacactccctgctgttttccctgcctggaactttcccaccagccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtgaaactaagccactaattgagtttctggctcccctcctggggttgtaagttttgttcattcatgagggccgactgtatttcctggttactgtatcccagtgaccagccacaggagatgtccaataaagtatgtgatgaaatggtcttaaaaaaaaaaaaaaaaaaaaaa

SEQ ID NO: 151 - DNA, 2024 bp, Homo sapiens
ggaagacatcaggatgtaccatctgcccttctgtcggaccccagggtacgtcccatgagcgcggccgagctgcgtcgagggcagcagagcgtgctgcactgctcagggacccggactctgcagtttctcctgcactgttttcacctttggccagacgggctctgggaagacctacaccctgactggaccccctccccagggggagggggtgcctgtaccccccagcctggctggcatcatgcagaggaccttcgcctggctgttggaccgcgtgcagcacctgggtgcccctgtcacccttcgcgcctcttatctggagatctacaatgagcaggttcgggacttgctgagcctggggtctccccggcccctccctgttcgctggaacaagactcggggcttctatgtggagcagctgcgggtggtggaatttgggagtctggaggccctgatggaacttttgcaaacgggtctcagccgtcgaaggaactcagcccacaccctgaaccaggcctccagccgaagccatgccctgctcaccctttacatcagccgtcaaactgcccagcagatgccttctgtggaccctggggagccccctgttggtgggaagctgtgctttgtggacctggcaggcagtgagaaggtagcagccacgggatcccgtggggagctgatgcttgaggctaacagcatcaaccgaagcctgctggccctgggtcactgcatctccctgctgctggacccacagcggaagcagagccacatccctttccgggacagcaagctcaccaagttgctggcagactcactgggagggcgcggggtcaccctcatggtggcctgcgtgtccccctcagcccagtgccttcctgagactctcagcaccctgcgatatgcaagccgagctcagcgggtcaccacccgaccacaggcccccaagtctcctgtggcaaagcagccccagcgtttggagacagagatgctgcagctccaggaggagaaccgtcgcctgcagttccagctggaccaaatggactgcaaggcctcagggctcagtggagcccgggtggcctgggcccagcggaacctgtacgggatgctacaggagttcatgctagagaatgagaggctcaggaaagaaaagagccagctgcagaatagccgagacctggcccagaatgagcagcgcatcctggcccagcaggtccatgcactagagaggcgtctcctctctgcctgctaccatcaccagcagggtcctggcctgaccccaccgtgtccctgcttgatggccccagctcccccttgccatgcactgccacccctctactcctgcccctgctgccacatctgcccactgtgtcgagtgcccctggcccactgggcctgcctgccaggggagcaccacctgccccaggtgttggaccctgaggcctcaggtggcaggcccccatctgcccggcccccaccctgggcacccccatgcagccctggctctgccaagtgcccaagagagaggagtcacagtgactggactcagacccgagtcctggcagagatgttgacggaggaggaggtggtaccttctgcacctcccctgcctgtgaggcccccgaagacatcaccagggctcagaggtggggccggggttccaaacctggcccagagactggaggccctcagagaccagattggcagctccctgcgacgtggccgcagccagccaccctgcagtgagggcgcacggagcccaggccaagtcctccctccccattgaaggccaagtgggaacccaggagactgctgtgtgacctcagactgggctccacactcttgggcttcagtctgcccatctgctgaatggagacagcagctgctactccacctgcagctgggctaggggcggggactgggggtgctatttaggggaacaaggggattcaggagaaaccaggcagcaggggatgaaatacatgaataaagagaggcatcagctccaaaaaaaaaaaaaaaaaaaaaaa

SEQ ID NO: 152 - DNA, 1024 bp, Homo sapiens
ttaggtaactatagaacagtggtacaaaaagcaggctgtacggtccggaattcccgggatatcgtcgacccacgcgtcccgccacgcgtccgctgcttaataactgtccattagctctcatgccgggtcagcaaaatgctttaatttttaactgcagaacatgtgactcggttgagtcttttgtcttttttttttttaaataaacaatggggggaattaatgtgggcaagttgccttatgttagaatgactaagttaaacctcttaattggtattgtccaaggcagacatgatataaggaatatgcactaccgtagtaactcccctggccgcagaaaccacactgcaagcctgtccggggtggggtgctgactgccatttgccacttttaaatgggcactgccgtggtaatgtgaatcccatcaatgcagtagatgggtggggaaatgaagatttccccccaaagctttaggcaaaagtgagtttgttggttgatttggggtttttttcccccctcctcttttggctttcacattttaaatcttaaatgttactattgcaggccgcaggctatgacaggcaatgagcaggtgaagaaccatggaaaacgtgttcaaaaactcctgtgttagctaacaggctgctgaatgtatcactgtggtccccagagaaggctggggggggtagccaaggagatgctgttcagctaattacaggcttaaaaccaagtgggtgtctcttggccttaaatgttcctaggcgactattcattgcggttaatcaaattacgaggttttccatggcgcaaaaaaacaacaaaaaaaaacaggggggcgctttaaattccgcggggcaacatttggttccctttttttaaagggcccaagggacgttaaagaaaggggggcggtaaaacggtgggaaaactatgtggtgtggggcccactggggctatggcaccacagacgccgaacacgtttgtgccctctggtggtataattatagtatgattagatagtctggcc

SEQ ID NO: 153 - DNA, 238 bp, Homo sapiens
ttttttttttttttttttttttttttttgcaaccaggcccaacacacaattttttattggtttagcctatttcgtacttgggggttgggagctcaatcttcagggaaacagaaaaaagagagaagtattcatgtaagtaggagatgagaagcagagtgagaatcacttttaggaacacagattgggagcaggtacaggagaatcctgggtgaggataagaatgacctgggatgggttt

SEQ ID NO: 154 - DNA, 1624 bp, Homo sapiens
gagactggcagctgcttctctgttggcccaaagggactatcctccaccagtcacccaaagaggactgtctttaaggatatgagatagcaccctaagaggataaatggacattttcttgtctacaaaaagcctaatgcaacagtagaggacatagggaaatttctttggatggatagagacaagtgcatctctttcttacgaaagaatagaaatgtgattaaaaaggaaaagcctagaaacatctgaacgtgtggaaatgggggtgagtgggctagagaaaggatttctgcatcactttcttcctgtagcaattccatccgagatccctgggacagacctggcctgatgaatagcaggaagcacaccagggagggacaaggtcctgcagacaaccttcaccaccaggctgggacagcgccatggggacccagggcctctgctttggggaaagaccttgctgagggccccatgggcaagaacaagtgtgaagaaccctactatggttttttgcccaatgccctccacaaagccagcgtttgaaggaaaactgtgaggaagaagggacactccatggtgttgttgttgccaccgctggagcagcctgtagcaagaacagtcttggtccaaccagatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggcaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcccggagaatgttgtgaggggtttatttttttttaatagtgttcataaagaaagacatagtattcttcttctcaagacgtggggggaaattatctcattatcgaggccctgctatgctgtgtgtctgggcgtgttgtatgtcctgctgccgatgccttcattaaaatgatttggaagagcaaaaaaaaaaaaaaaaaa

SEQ ID NO: 155 - DNA, 2423 bp, Homo sapiens
ttagccttcatgagtgtccccaccatggcctggatgatgcttctcctcggactccttgcttttggatcaggagtggattctcagactgtggtgacccaggagccatcgttctcagtgtcccctggagggacacccacactcacttgtgacttgagctctggctcagtctctagtacttactaccccaggttctaccagcagaccccaggccagtctacacgcacgctcatctgtaacacagacactcgctcctctggggtccctaatttcttctccgcctccatccttggcaacagagctgccctcaccatcgcgggggcccaggcagatggtgaatctggttattgctgtgtatcttatatggaaagtggcgtatgtcttcgcaactgggaccaaggtccccgtcctacgtaactggctctcaacctttcccagcctgtctcaccctctgctgtccctggaaaatctgttttctctctctggggcttcctcccctctgtcctcccagccttaagcactgatccttacctttctccatggggcctggaggaggtgcattcgtctccgggtaagcggcaggagtggcctccacagcggaaggagccggatgcagcctggtcccggggcctgagctgggattgggcagggtctggactcctcctctcttccagggcacctgtctgagtgagggacagaggttgcctctgatggggggccctgcagtgtccttagggacactacccagtgactcctggggtcaaggacagaggctgctggggtgggcctgggaggtgctgagtcccatagtctaggggagcagccccaagaacagctgagggtctagactgaggactggatgccagtgcagcctgggagggccacacggcctggtgacacagaggtcaccccaagggcagaccaatggggggcacagagagggctctgggtctaggctgcagctctgtggcctgtgctgggtcatgaggacatggggacacagagggacgggtgagactgggtgaggtgccagaatccaaccctcccaggacagtcaccagaagggggacagtctcttagggcagagatgtgtctgtccctggagccccgtcacctctggggcccagtgtctctctgttcacggatcggcctcctgccttcctcaaagggcatgttagactcaggaaatgaccagaggggagtgaatgaggggtgcagagaactccatggctaccaggtgaagtttggggtcatcacaggctgctggggtgggcctgggggctgctgagtctcatagtctgtgggagcagccccaggaacagctgaggtgaagggttctgtggtcgggcttgtggagacaggaaacatctcagagcctcagaggagccctgaggcttgtctaggtggagcccactccttgccaggagagccaagtgggctgggctggggcagagcccggtgcctgtgagggataggaagctccagttcaaagcaggcttgggtctccccacacactgcctgccaggacagtcctacaggatgagcaggggacccacagttcacggaggaggctctaggtcctggaagaataaagtgggtgatggaggggggtatagggatggaaatgagggatccaggggtcaaggccagattctaaactcagactccagagatcagagaagaaggaacacagcctgccctgggtacatggagaaattgaggctgtagaggagaggggctgggccaggacacctgtgaaaggtgacttgggagggctcctaggaaggcacagagctgtctgctctccacagggcatgagtggaaaggatggggaaagaagaggagagaaccccgggtggaccggatggccacactgtgaaccctcccagagactttagacagagagaggggctccacaacaccccggtattctgtctgccctctctcacccccttccctgtccacacaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcataggttcccaactctaaccccacccacgggagcctggagctgcaggatcccaggggaggggtctctctccccatcccaagtcatccagcccttctccctgcactcatgaaaccccaataaatatcctcattgacaaccag

SEQ ID NO: 156 - DNA, 612 bp, Homo sapiens
  misc_feature (342)..(342): n is a, c, g, or t
  misc_feature (444)..(444): n is a, c, g, or t
  misc_feature (456)..(456): n is a, c, g, or t
gtaccacaaaggcaaatgaggaaatgactccccccacctcacacacatggaatatttaaacaaaaatgccctgctaatctttagagatgccagtgttttcaacacatgaaaggtacccagtaaatatttaaagaaaatacacaccgtaggttctctaatgaatttctttttcttctaaataccatctggcaagatggccagaatcgtggcggtccgtttcatcttaacgtttccattcaggtttcacctccttttccataaggccttggtgtgagctgagattgaatgtttaattgaagaggacataattttcacacatacagcaaagatttgatgaggctntgaggtttattgtagccattaaagtgtcgtagctgctgggcaaatcccagaaaatgtctaaagctaaaccagatgtgattagcaaatttcaagaagtatcangccctagatctncaggcaggcagagtcttttaaaaaaaaaaaaaaaactcgagggggggccgtacccattcggcctatatgaagcgtatacgccgctaacttgcctcgtttacacgtgggattgaaaaccccgcgttacaacttaatgcttggaaacatccctttgca

SEQ ID NO: 157 - DNA, 2547 bp, Homo sapiens
ggattggctgttcggagcggcgaggggcttggcgggagcttccagtcgctcgagagcggagagcggcaccatggccccgcgggggcggcggcggccgcggcctcacaggtctgagggcgcaagacgttcaaagaacactttagaaagaacacattccatgaaagataaagctggtcaaaagtgcaagcctattgacgtgttcgactttcctgataattctgatgtctcaagcattggcaggctgggtgaaaatgagaaagatgaagaaacttatgagacctttgatcctcctttacatagcacagctatatatgctgatgaagaagaattctccaaacattgtggactgtctctctcttcaactcctccaggaaaagaagcaaaaagaagttcagacacttctggaaatgaagcaagtgaaatcgaatctgtaaaaattagtgcaaaaaagccaggaagaaagctcaggcccattagtgatgactctgaaagcattgaagaaagtgatacaaggagaaaagttaaatcagcagagaaaataagtacacaacgtcatgaggttattcgaaccacagcgtcttcagaactttcagagaaaccagctgagtctgtcacttctaaaaagacaggaccccttagtgcccagccctctgttgaaaaagagaacttggcaatagaaagtcaatcgaaaactcagaaaaaagggaagatatctcatgacaaaaggaagaaatcaagaagtaaagccataggctcagatacttctgacattgtgcacatttggtgtccagaaggaatgaaaaccagtgacatcaaggagttgaatattgttttgcctgaatttgagaaaacccacctagagcatcaacaaagaatagaatctaaagtttgtaaggcagccatcgccacattttatgttaatgttaaagaacaattcatcaaaatgcttaaagaaagccagatgttgacaaatctgaaaaggaagaatgctaagatgatttcagatatcgaaaagaaaaggcagcgtatgattgaagtccaggatgaactgcttcggttagagccacagctgaaacaactacaaacaaaatatgatgaacttaaagagagaaagtcttcccttaggaatgcagcatatttcttatctaatttaaaacagctttatcaagattattcagatgttcaagctcaagaaccaaacgtaaaggaaacgtatgattcatccagccttccagctctgttatttaaagcaagaacacttctgggagccgaaagccatctgcgaaatatcaaccatcagttagagaagctccttgaccagggatgagaagagcagtctactaaaatgtgcctataggaagactagtctcatgctgttaccttctgaaactgtacctttataaatcaattgttttgcaaagaagttatggcctacttagaatctaaaatttgttattcaaattaaatggctgtgaacaatgttaaatagcatcagtttgtccaatagttttaaaggccataatcatcttttctggttaatatcttgagtaattttaaaatgttgacaccttaatcggtcccaggtatgagctataataaacttgtaaaattaagttgatgtgaacataattttgattaattaataaggcgatttctcctgaatttacaccaaagctaatttttaatgaaattggtttacagaagtaaaaaacaaaaattggaaagcaaagtaataaaacttagtttatataaacaggttgaatgatatatttatcaaatctcacagacatcaggcaaattatagcctggtgacaaaagtgttcatagtgaattagttactcttgtaatacttctataattagttcatcaggaatttcatccacttcactgttataactgagaagactgttctctgcagcttcagctaattcagcatcttcagtagcttctaaaaaataagcatcatcaatgccattatcccagacagcatcagcagatgcacctgttgacagcctgctaggtgatggtttatgaggattctgggtttcattgctcctagtttcatctgcttcatctgttgtaaactcttcttcctttatttcagtggtgaagggatagagagtgggataggaaaatatttactcaggatatgtgatttaaccttatactctatgttgaagtaaggtattaagtgacagatactaaagtgaatatgcaggaggaatgctgtctccgatatctcaccgtgggaatgagtgcactgattcaaacgttgctgcactgaagctcagacacacttgaaactccaaatttgaaattacctacagttctgtgcacatacttttcaatactccccgacggaagagcaagggtggatttaattttttaacaagtggacagtccagctgaagacaaatcagaagataaatttgctatcttgacaatggacttagtacccatgctttaaattttaaagtatttagcaaatcgtaaacatggattgaaaaaagattaaaaacagttgccaaaatataaaaaaaaaaaaaa

SEQ ID NO: 158 - DNA, 714 bp, Homo sapiens
tctgtttatagctataggtcaggagatacttgtgggtaattgggatgagacatgaagagaattgactcatcaaaggagttatagggctttcaggcaaagcttaacagacttatcaagtaaggaagaaggagagtctgcctctgctgacggtaacaggaatggctccaaatgttgttagcgctcctatacagcctcatccaattctcagcttcccagccactcctaaccatgccctcactctcacatacgacacctcacgaggttgtgaattcaactgttgtaaattggcagcccataggatcaaactgtgaaattgtttttatcggagccctgtgcctgcaagacatgagagattctcttaacaaggtcacagaaagtgcttgagcttccttatgtgccttgagcaaagaatgtaggaattggatctgaccatcatctttccttatgctacccagaagcagccacgcccctgtatcttccttgatttcctcccatcatttatgctttcacaaaacagtgtccactcagtttcccaaaaccttgctgcaatgagcaccgcattctaagtaacgacaggcagtatttcaattcattgtttctgggctacaagccatgaattggtaaattatcactatttaatatttttattgctttttgtcccaaccgggcctaattccccagtttacctatgctctgggtagcactgactggtac

SEQ ID NO: 159 - DNA, 3759 bp, Homo sapiens
gctcacggagcggctggctaggctgaggagagctcgccgggctctgaggcgcaggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcattgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaaggattcatcagatgacagagtttcttcaaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacacacacacacacacatatcacagttttgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttatctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttagcatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgtcccaaaaaaaaaaaaaaaaaaaaaaaaaaaaa

SEQ ID NO: 160 - DNA, 1390 bp, Homo sapiens
gggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttcctttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaaaaaaaaaaaaaaaaa

SEQ ID NO: 161 - DNA, 4471 bp, Homo sapiens
caattacatatttatttttccatacctgatttttttcaagtctgtaataaaaaaagtataagttgagattaacataggttatttttcatgaagtatagcaaacgatctagaatgtgataggagtgtggtttccatttctttttttttttttttaacagacttttgtgctgtagtaagaatgtcttagaagttgtgtcttcgagttcctcaaacaccggacagggctcccccagagctgcctcagcctttgatttggtccatattcagacacttcctgtcttgcatacactctgaggatgggccgcttctagctgccgcccgtctccctcttgccttcttgtctctaaatcagacactcccaagcactccatctgctatactaggagagtgggagagccaaagcattttggagtccatgtaaagtgcctgggaaaagagatgtaagagcagtgggagtttatataattagcgaattcttttctcagaattcagcggaaatgtatttctgttgttattatttacaaaattgtggcctcagaggagctgtcttttggaaaataagttttcattcatgcagttagttagacatgcacgatgtacttgaatcaataaactgtggaccagaaaagggctgcttaaatgaattcacgtgttctaattctctttcgaggctgttgatgacctcctggattcatacccccatgatctgtcttgctcttgcctctgttctttgataaagcacatcagactatgtgacacccatcttttcaagaacgacctaaaagcaatgacaacaggcaggagagaattaccactggcctgggcacagtgacagcagaaggcccacctgagcttggagagttggcgagataaggcaaaatcaaggtgcaacagtgggccatgttccaagggtgaatggatctgagagtccgctgatgttccttactgatcagaacagggaccttctaacgaaacagccagagttccttgaatcaggcagaagttctttagagacaggaagccagagctattgataatatccgaacgacagaggaaggaatttcttattagaaattctaaaataaaacaagtggggatttggttggatacccttagaagctacatttttctctcatccctaagatagatatctcaagtgtatatctgacacctcttggctttgacacggctctgcttctcaagtgaccatttgttttaagtctgttgtctagaattctttgtgggggctggacctctgaaaaagattctcactgcagaggctttaaatctgtgtttttttccactccctccgtcctgggatgtattcggtaggacatttcatttatatcaggatattggctgattcagctctctttcatcgttattattcaggcctccctccaccaccttgttctttattgcctaagtattgccctccccaattcttcatcgtaatagctctaaatttagtttgacccaaattaatttttgttccaacagatatattttaagacagagaagcctctctcaggagccagatgatctgaagatgatgctaatccccaaatacgaagttcctccagctaactctcctctgagctccctcttcttagctttgggattggggatggtctcatccttgccaggaatccctttgttgctcccagtgtctctgatgagcttctcctccctcccagagacaatgcaggggtggttttcagcagaatgtgccacctgcacttctgattgttctgagacccagcccagaggggtggagaaggcgcacaaaccctattccaataaactgcctgcagagaaccacagcctgctaatagtcgttgaggtctcagccccctaaggtctccaagctcatttgaccagcgcagctgcgacttcggctgtctgcctctggcaggtgccaatatcagcatcttgtcccactgccatggggagttaatttttgctccagggcagctgccaagcccagcaccggcatcaatagaaggttttctctgattttcttctcttcctctcaggctaggctttcttaccaatccccaatttccttctgtagggcgccaggagactggccagagatctttagactcttacttagtttgaacatctcttgctgctcacacccaggcttcttcagcagaaagcatgacccatagtaggtactcagaaactggttgaatgaaaagccttgacatttaagggctttattctgtcatacggtggcaagaactggcctattggcatcgtattcctggcattgagctgtattgaccctgaatgtgtcctcctgaggtttttgagggtgacctaggagaaagggtctgaaaaagcactgggatccaagtgactttaaatctgcccgtggcatttcctgctgagaggcgagaaactagcatctctcccaacaggctcacatccgccaggaaggacagagtccaaaacgggggtagactttgtgggaaattcgccagttagtccgctgagattttaatctgcctcaagcacaggatgctgacaagaaaggtagaccactcccccgatcccagacaaaccccaggggtgacaacttctccatcagtatcctgagaagcaacatcaaatgcttaccaagtcagcacgtttactgagtgagtactctgacggaataaaccagcatttggagctgaacttgagaacacagggccctctgacagcagcttagggaaacacccatcccttccagattggcagaatccttccatttcatgtccttcggagacgctgtattctctttacaaatcattcatgaaactgagactcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcacacacacacacacacacacacacacacacacacaatgattggagggctatatgatccagcattagcttcctggtgtgccaagcatgcttgatcgggaatttttttttattattattattttttagctgtagctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaaacagtttcagaaacctgaatccagggccttatagttctcctcattatcgatcttcttctcccttccctcgcccaagggagtgggggaaacacttttcactgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctgatttttagggtatttttagaattcattcctgagtgtggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttaaaaaaaaaaaaaaaaaaaa

SEQ ID NO: 162 - DNA, 633 bp, Homo sapiens
  misc_feature (533)..(533): n is a, c, g, or t
  misc_feature (610)..(610): n is a, c, g, or t
  misc_feature (633)..(633): n is a, c, g, or t
aaatactgggattataggcgtgagccaccacacccagtccacttttcatactttctaaaacaatatttagggatttttgtgttagccactctcctatctcatttctccaattgaagtaatgcataaatcttccattctcttttttctctcattcatggatagaatgaatgtctataatgaaaagagcttcttatcaatagccctctcagatttgttctgaattttgccaaatatttgtataactctgcaaaagactttctttccctgccttctcctttagagggaaaaacaaactgtaggtgtgacagcttacctcctagcattgttgtgaggtttggctggcacaagataaagtgctgtgtaattactctgaaatgtttgtaattaataaagaaatgaattgtaggcactttgtcagtagaaaccactgtgatttggaaacgcaatgtttcaataataaagactataaaatttaaaaaagaaaaaaattaattctctccaaattataaattaaatggtatacctaatgactntccttagaacttgaaaagcttaacccaaaatttatatgaaaaggcaagagcctggaatggttaagacaaacgtaaanaaaaaaaaaattcacttggcgtn

SEQ ID NO: 163 - DNA, 5848 bp, Homo sapiens
atgccacagtagtgcctgtagcagagaaaggattccctcctccacctcagggcccactgctgctgctctccagcctgcagtttcctctaaggctctggattggctggaagagcaacagagggctgggaaagagcttctatatatacctcaggaggaaaggcatcccagacagttttgaagttttcaaagactggctctgctgttaagaagttgtacttaaagcggaggagctaagccacctgccaaaatgtgcaaaggacttgcagctttgccccactcatgcctggaaagggccaaggagattaagatcaagttgggaattctcctccagaagccagactcagttggtgaccttgtcattccgtacaatgagaagccagagaaaccagccaagacccagaaaacctcgctggacgaggccctgcagtggcgtgattccctggacaaactcctgcagaacaactatggacttgccagtttcaaaagtttcctgaagtctgaattcagtgaggaaaaccttgagttctggattgcctgtgaggattacaagaagatcaagtcccctgccaagatggctgagaaggcaaagcaaatttatgaagaattcattcaaacggaggctcctaaagaggtgaatattgaccacttcactaaggacatcacaatgaagaacctggtggaaccttccctgagcagctttgacatggcccagaaaagaatccatgccctgatggaaaaggattctctgcctcgctttgtgcgctctgagttttatcaggagttaatcaagtagtaatttagccaggctatgaaatcatcctgtgagttatttcctccataataaccctgcatttcccattaatctacatatcttcccacagcagctttgctcagtgatacccacatgggaaaaatcccaggggatgttgcttactctttttgcccacactgctttggatacttatctactgtccgaaggccttctttccccactcaattcttcctgccctgttattaattaagatatcttcagcttgtagtcagacacaatcagaatcacagaaaaatcctgcctaaggcaaagaaatataagacaagactatgatatcaatgaatgtgggttaagtaatagatttccagctaaattggtctaaaaaagaatattaagtgtggacagacctatttcaaaggagcttaattgatctcacttgttttagttctgatccagggagatcacccctctaattatttctgaacttggttaataaaagtttataagatttttatgaagcagccactgtatgatattttaagcaaatatgttatttaaaatattgatccttcccttggaccaccttcatgttagttgggtattataaataagagatacaaccatgaatatattatgtttatacaaaatcaatctgaacacaattcataaagatttctcttttataccttcctcactggccccctccacctgcccatagtcaccaaattctgttttaaatcaatgacctaagatcaacaatgaagtattttataaatgtatttatgctgctagactgtgggtcaaatgtttccattttcaaattatttagaattcttatgagtttaaaatttgtaaatttctaaatccaatcatgtaaaatgaaactgttgctccattggagtagtctcccacctaaatatcaagatggctatatgctaaaaagagaaaatatggtcaagtctaaaatggctaattgtcctatgatgctattatcatagactaatgacatttatcttcaaaacaccaaattgtctttagaaaaattaatgtgattacaggtagaggccttctaggtgagacacttttaaggtacactgcattttgcaaaaaaaaaaaaaaaaagtaatcttttagcaaccccagtattccttcactatttcgcttcctgcattagcaaattttacttacagtcaaaagtgcagatttatactcctgacgtgtctcattcacagctaaataataggccataggacttttggtaggtttaaacttttaattctgtatttcatgattataagtcttgctagaattttttctaatctttagtagatttgattaaataatgattcacagaatttagtaacagaatcaaactaagccatgtatgagggtaatcgagatgaggatattaactcaaaagaaatagggtgatttttaaaggattaataaaattctgaaatgttaagtagaagattacattgtctagtcttgtatttcctccttctgttgctctctttcattcacacactctcagtttctcatatttgtagctcatttatttggttatttcctaagaatattgaaagtgaagcaactatgtgactgtattcttcaggtaaacactgactgcgcttgttggattttccctatttttgtgacttcaagaataatatgccctgctgaatacatgccatttcacattctgaaactgggtagagtggttgggtgttctgccaacaattgctagtggtgtgaattcattcatatttgccagtattgctcacttcaaagaaactccttcatcaagcagtccagagctaggccagatcaatgctacaatcatgaagttctcattgcatgcaattgtgtaggattgacaaggaactcagataaaaatttccagggtgcacttccagaaccagcttcaacatatgtctacattgcccccaagttaataaagtgccaaccctttactctctcatacagccagaaatgttagaaatccaaaatcttggtgcattattttttcataaacgctaaaacatttgaagaaacaatttaattatttaaaattcaagtattttattcacattatttgcaatatccaaatgtttaaaaattcccagataattaactagctattacagatctcacctagagggttgatgttatgaagactccagtggactgtactcacaaattgactggacaccctatgaaagtgggtagacctctcagcggaaaataagaagggcttttacctacagggcaggacagggtcccatgagagcagttctgtggagatataaaaagaatggaagaaggaatgccttatagtgatattgtgacattatatctatatatctacatatatctatctatctatatctacatctatataatcttacatttaaaattgtattcctacacatattagaaactcttctaataaatgaagtaaaaaaattaaaaagaatacaaatattccagccccaaatgagaaatcaaacatattaaaattgttcaagaaaatttctttgaacacttctgaaagtttttggaaacttagaaaagagggaaaaaaatccagtgttactagtaatttccatggtaatacagataaaatacattcttttaattctgggaaattagaaaaagtggggtgatctttccaggaaaaacatgtgtaacatctgcttatcactccagctccctcctcctcctcctctccacgttcccttgagtaaatgtctgggaaagcatgaagcttgatgcaagaaccctgttgtactggcgttttcctcccctgtgaaaacgtaactactgttgggagtgaattgaggatgtagaaaggtggtggaaccaaattgtggtcaatggaaataggagaatatggttctcactcttgagaaaaaaacctaagattagcccaggtagttgcctgtaacttcagtttttctgcctgggtttgatatagtttagggttggggttagattaagatctaaattacatcaggacaaagagacagactattaactccacagttaattaaggacgtatgttccatgtttatttgttaaagcagtgtgaatagccttcaagcatgtgaataatcttccatcttccccgccacacatacacacacacactttttgtttctttcaggtagacaccttttaaaatgcagaactaactgaggcatttcagtaactttgctttcaaatcaataaagtcaaatgtatggaaacattttgtgccctactctccataccccgtgtactcaaattctctactgtatgaattatgctttaagtagaattcagtgccaaggagaacttggtgaaataaattattttaattttttttttatcctttacaaagccatggattttatttggttgatgtgtgctctgtacacaagccatttcaataggatggagctgttaattattttccaaagagtaatagacatgcaaaagtttcaataaaaactgggccattaacaaataaattaataaactaataagcattcccttctaggtttttgccaaactgcctatccaataacaaatttgagaatcgttgaaaaagctagttatatttcagagaaatgattttcattattgaaactgttctccctagcaggccattttccctttttcctgggagtttagcaagtttaggagagaatagtcatgaaaagaaagggaagaaaggggagaagggaagaggttaaaaagtaagtgctcagacctatgaacgtaatccctttgctagaaatatttaagagcagctcagcttggttgaaactgagttttgtcatcttccatatttgcaggaaggtattttctgacttgcaatgcagctagatgtaaaattttattttatcatcctagaaagccttgactagaaaaatgaataaatattgagggtttcctgtccatatctggcttgcatgtgccagaaagcagagaatagaaaatgtaatctccaacatccaagcatcgaaacccaaggggtaggcaattctatgtaggttttggacatgaagtttggtgcatcttggtttatgctggctcaactgctattaaacctctctggcttatagtctcttcattctattagacaagcacgtatcgaacacttgcttcgcacaaggctctttagttaacaatttagcagctactgtttgtgttaaacacacttttcaccaaataggttctgaggcaaacgagagcaatgactatttaaagaaaggctttcccagcatcacttacacatcccaaaactaaaaagatcaactcttccaactgagaaaagactcctggctttgaatggaaacttacagcagagagtcacaggccacggcaacaacaacgacaacaacaaacatttggaatattattctcaactcacgttttaataatacatcttattatttttctagtagagaaactacaaatcagcctcttcaacatttatatacagtttaataagcctcttgcaagttacttgttctctcacctgaggtatttttttcctccccaccttgcccctgttcctcccttcctcttctccctttgcaagaggaaatatttaacatatttgggtccaacttcaataatgtaataattaatacattaaaagcatttaacttcctttctagaaaaatgcacaggctaaggcatagacaaaacaaagagaaatgctgagaaatttgccactggagacaagcaatctgaataaatatttgccaaaagttctttttatgtcatatagtgtcaggatttgaaggagctatttttttttaatgttgcaactagcaactcatcttcggaagacacagccaggagaatgaagtagaagtgaaaggtttataaatccatttgtaagcatttatcccatatattttaaattcaagaaaaattgtgtttatctttagaattttgtattcaatactttatgtactatgtgactcatgcttctggataaataaagcaccaaatatgtatctgtaaccacaatcacacatattatattaaatatatatctataaaaaaaaaaaaaaaaaaaca

SEQ ID NO: 164 - DNA, 8992 bp, Homo sapiens
gcaccctcacccctcctccacccctactcagctttctattcaacaagtgagagcaagggcggggaagaaagccgacaggggagaggattgcttccctttcttttcccattcccccttaagacgaaccaggaagtaaccgcaagaatcgggccaccttaacagtagagtaatggtttggcctcgcgccaagtcccacctctgttccagctcctgctcctcccctctctcttcccgcactgcttggggagagctggtgagcaagagtctggcccgagttagctagagctgttgccatgacaagcattttcttaagaaagctctgctgttgagatcgtccaaagctgggggctgggagggggggcacgaacttcgtggggcaccatccctccgaagagagcaagatcagagacacccgcccagctctcctgcaccctttttctttcaggaacctgagaggtccttcccattggaggggcagggggaggagacccagcccactccccggccttagccagaaaggcaagagagcaaagccagcgtctctagcttggttgccgcactggggagactggtgggtggtcaccccaccctaccctcatccatggaaacccggagggagagtcccgcctggagaaacctggatctttgctagaaagagagagatccagttgtcatcggtatccaggaagctctcctcttcctcctcctgacgtctaccactacagttgctggttgttgctaaggttgctgccatggtaacatgcacatcctgtttacaccttcatctgggcaagttggtctaagctaggaacctacctaccctggacaaccactatcatcaccacctggggacaccaatcatcgtgacacggagtccaccttccactcagttcccccatcctcttcctcctctcgctgccagacttcatagagaagaaaggatctagacttcggacggctactcgggagcttattgcacaagatatattcaatctattccctcactgggcccccagagaggcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggcctgtctgggaaccctgcagatctggagaaacgtaggcaggtgtttggacacaacgtgatcccccccaaaaagcccaagactttcttagaattagtgtgggaagctcttcaagatgtcacgctcatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccatgccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaatttgccatagaggaggagttgccacgaacaccactcctggatgaggaagaggagggaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtgattgtttttcaatttttcccactttgaaaacttacacctaaaggcctgtaggcctctaactctttctgccctttcattcaaacctctccaaagttctttgtcttttgtcttcccttcctttccttttttttttttttttttatgatgattaagaaaatggaaaggatatggatgaattgtgtaaacttagatccttctcccttttggcccaaaagaacccttgatttagttccagaatccaaccagtttctttgttaaaggggtccttttgaagcaattaagtgctggtaagaatatttctctgttgttgccaggttaccttctgcttttaaattgccatcttgtaaagtgtatgtggttcttaagtgccagggagatcagccttgcccatgaaggttgcatatgtgtggtatacagtttttacctgaaagcctgagctttctcttattcctaaagtggtggcaaaagaatgaactgggtatgaccctgcccccttactgggcttggatattgaggaccagacgctgccaaatctaggacaagacagaccatcaaagcagacttttgtgggctcctctttggggtgaccactgctttcaaagccatctgccaaggctctccagggcaggacctgactggtggggaatgagtgttcagaagccttgggagaggccaaagagccattctagcatgatctgagaaaaccttcctgcagaggccagaaaccttgagcttaggtgcctggggaccagcttcgacattctctccagtttctgattctaatttttgccacgtgtcacaacttttccagtctctgagaaggtcccagcctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttcccctgaatactgcccaaagcatccccttcccatctgcctctcaggagttggggactttgctaggggattttttaagtgttccttactgggacaacgtggagccacgtttgcaggagctccatttgtatccctgctggtgttgacttctgtgtaggggccagttcatgtccctgactctcacctcccattagataaatgaagcccacccccctttctagagtgatgagagtcaagaagaggggatgtatgaacggccaaattcccatgtgagaggaagatgacctgatccacctagccttttcttctggatctgtcctccctcacccctttcacctgagctgtccacagtaggaaacataaagaaacaatgtcccctacatatccccatgactacataatccatcatcgtaggaaataggaaagcaaatttgattttggttttgtaaaacgtacatgcttcaataattcttttttgtgtcttaaatactcataggggaaaaaaacagctcacccaaggtgttaggtttcacatatatattcatcaactattttagaagatttaattctatcaaatcttgtattacctcagatcattttaaatagcaagccaataacgagctttgaaggctattttaccattcctgttcacaaaaggttctcatggtgcctgacaggttacccttgagggcttgtgtctactttttaaaagtcaatggttttttttcttgtgttctagtttccataataggagagaaaatatagaaatatatgcaaaaattatagttttctttagatcagaaactgatatttttgggtcagccatatgtattttgtttaaaggatttaaaataaagtgccgtcatgtagccctgtggaagggagcacataaccagctgtttggcatgacaggtgacttagtatatttgtaattggttttaaaaccaatacaccatactttctttctgcaaacagccatctttatacttagggaagaaaaattgttgggttctagacttttttaatataaattttgttgatatggaattaggtaagtttaagtgtctatgtgcatatgttttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttaataaacctagaaaaacgggtagtaaactgtggatagtcaggaaaacacccagcaagggacacagctgtcaggaaatgaatcttccccccaacccccaccatgcagatggatagacagaatctttcctgactagtcattaggatcaggggcctctgttggatttgtgtttcttgaagaatagctggcagagtggtataaaagacacgaatatctcctggtctataaggatactctgatttggggtttgcatttttcatggtttttatttcctgttccccctggagttttccattagtgagtttttgtgcaaggatcttatttgtgatgccttccctcccctagaaagattttgtgcaatatattaaatggggacagaattctaaatggataaaacaatggctggttctagccctgagtgacagtcttaaggctagatccttcccatagtatcatctgtcctctggaatgactctcctgtccctaaaggggttaagagagagatcacctagaaatccctctggacacttgtgggttctttagggtttgagtttcttcttccccttgagcttcagagaggagagttggcatggttaaatctgaatggttacctcactgctgaaaacccagaggggcgtggcacactcgcttgtgtggaaaagcctctaaatgcatcccttcctttctttcctgcttcctttgccttacaattgaagcagcccgtggtaccatcacagtatgcagagacttcctcacctttcatatctagggaccacccccgatgcattggtgagggtgggcacttataaatgcctgctattgttaagccattccagcctcttcctctgaatagaccagacgccctttcacttagttcagtgccagtccttttgccttcccaaccctgctgttaggcctgctgttccctttgctcttgattaggagagatggaaggagatgagctcccataactgaattggcctttggttcatgttttctccccatatgtatatatgccatatgtgaatatgccatatatatgtgccaacaaatctatctacgttgttcttttcaaattagcacgcagataggaattttgagtttcttcttcttttagtaactagtataacaagcactggtatttttgtacaaaaaagaaaaacaaaagattgactattgtggtctgcatgacataaacaaacaaatggtgatatcaaagcaacgtataccccagtccagtgtgtgttgccataatttgcaattcagcttaacagtgcacccaatctatatttgcattttgatattatttaagctctatgtacaaggttttgcatgtatttatatggttcttagggaaaaaaaatgctataaactgcaaatctgaaattcaaatgtgttgttccactgagaccagaagaagaagaggagttttaaaagggataatttgttggagccaataaagctttttgctgatgaacagaaaccaatactgctgtgcactgagaataaaaactcatgcccacttgtaaaaaagaaaaaaaaaaaaaaaaaa

SEQ ID NO: 165 - DNA, 1568 bp, Homo sapiens
gaattccggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctgaccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 166 - DNA, 8839 bp, Homo sapiens
atgcagagttccatgaataggccttacatttgcttggaactgggggccgagcaacctgcaagcaatcaaggccagtctaccctgcagcccttgccgccttcccataagcagcactctgcacagcatcatccatccatcacttctctcaacagaaactccctgaccaatagaaggaaccagagtccggccccgccggctgctttgcccgccgagctgcaaaccacacccgagtccgtccagctgcaggacagctgggtccttggcagtaatgtaccactggaaagcagctgtgttgatgtaaaagagcgccctgctcgtccgcttgctgcagccgcccggtctgcagggtccgcggcggcggggagggattctggcgtcctagcgcttctgcaggcccgggtttgggggtggccgctcaggtcagggctaggacccagcactggctttgctggacaggccatcggactgcctcctgggaggtccccaagccaggccacaggcggtcctgctgcaggggtcctaggaggccccgggtgctctgcggaccataaaaataccatggccatgaaaggagctcgcccgccagtgacctgggtcagccaggggctcaggggcggcttccctatggcactcggtgccgccgcaggagctgctgttggaagtggaacctactgctatgtgtttaaaggaaaaataattcatttaataactacaaagagggttttcatgggaccaaagactaaggtaagggactacgtcgttggccatgggcctgcaaacctgtcgctacctgagttttgcgtgtttctctacacgcagctttgccagaatgccactcacgaagcagaaggcaggcttctctccctgggccctgttgctcctctgctgttaccagctcccctcaggttctccacctgctcccagcgtggacatgttcccctttctggagggaagccctttctcccctcacaccatttttctccccagtccactctatttcactcagcagtctgggctttagaaaaccggcatttcctattcaaaacaggaacaggtacaacgccactgttcagtactgcaaccccaggatacacaatggcatctggctctgtttattcaccacctactcggccactacctagaaacaccctatcaagaagtgcttttaaattcaagaagtcttcaaagtcagtgccgttactttatgtattggatctgaagggctttttgacagtggtagtcatcacactgccttcttattcttcctccattgcgctggtaaattccagtacatacacaatgcatctctttggcctcaactggcagctacagcagactgaaaatgacacatttgagaatggaaaagtgaattctgataccatgccaacaaacactgtgtcattaccttctggagacaatgtaaaacctacagacaaccttagtgtttcctatgatcattcccaggttcaggctctagggctttatggaggtagtgatctcagaaaattaggtggatttacgcaagaaaataacaccatagattccggagaacttgatattggccgaagagcaattcaagagattcctcccgggatcttctggagatcacagctcttcattgatcagccacagtttcttaaattcaatatctctcttcagaaggatgcattgattggagtatatggccggaaaggcttaccgccttcccatactcagtatgacttcgtggagctcctggatggcagcaggctgattgccagagagcagcggagcctgcttgagacggagagagccgggcggcaggcgagatccgtcagccttcatgaggccggctttatccagtacttggattctggaatctggcatctggctttttataatgatgggaaaaatgcagagcaggtgtcttttaataccattgttatagagtctgtggtggaatgtccccgaaattgccatggaaatggagaatgcgtttctggaacttgccattgttttccaggatttctgggtccggattgttcaagagccgcctgtccagtgttatgtagtggcaacgggcagtactccaagggccgctgcctgtgtttcagcggctggaagggcaccgagtgtgatgtgccgactacccagtgtattgacccacagtgtgggggtcgtgggatttgtatcatgggctcttgtgcttgcaactcaggatacaaaggagaaagttgtgaagaagctgactgtatagaccctgggtgttctaatcatggtgtgtgtatccacggggaatgtcactgcagtccaggatggggaggtagcaattgtgaaatactgaagaccatgtgtccagaccagtgctccggccacggaacgtatcttcaagaaagtggctcctgcacgtgtgaccctaactggactggcccagactgctcaaacgaaatatgttctgtggactgtggctcacacggcgtttgcatgggggggacgtgtcgctgtgaagaaggctggacgggcccagcctgtaatcagagagcctgccacccccgctgtgccgagcacgggacctgcaaggatggcaagtgtgaatgcagccagggctggaatggagagcactgcactatcgagggttgtcctggtctgtgcaacagcaatggaagatgtaccctggaccaaaatggctggcattgtgtgtgccagcctggatggagaggagcaggctgtgacgtagccatggagactctttgcacagatagcaaggacaatgaaggagatggactcattgactgcatggatcccgattgctgcctacagagttcctgccagaatcagccctattgtcggggactgccggatcctcaggacatcattagccaaagccttcaatcgccttctcagcaagctgccaaatccttttatgatcgaatcagtttccttataggatctgatagcacccatgttatacctggagaaagtcctttcaataagagccttgcatctgtcatcagaggccaagtactgactgctgatggaactccacttattggagtaaatgtctcgtttttccattacccagaatatggatatactattacccgccaggacggaatgtttgacttggtggcaaatggtggggcctctctaactttggtatttgaacgatccccattcctcactcagtatcatactgtgtggattccatggaatgtcttttatgtgatggataccctagtcatgaagaaagaagagaatgatattcccagctgtgatctgagtggattcgtgaggccaaatcccatcattgtgtcatcacctttatccacctttttcagatcttctcctgaagacagtcccatcattcccgaaacacaggtactccacgaggaaactacaattccaggaacagatttgaaactctcctacttgagttccagagctgcagggtataagtcagttctcaagatcaccatgacccagtctattattccatttaatttaatgaaggttcatcttatggtagctgtagtaggaagactcttccaaaagtggtttcctgcctcaccaaacttggcctatactttcatatgggataaaacagatgcatataatcagaaagtctatggtctatctgaagctgttgtgtcagttggatatgagtatgagtcgtgtttggacctgactctgtgggaaaagaggactgccattctgcagggctatgaattggatgcgtccaacatgggtggctggacattagataaacatcacgtgctggatgtacagaacggtatactgtacaagggaaacggggaaaaccagttcatctcccagcagcctccagtcgtgagtagcatcatgggcaatgggcgaaggcgcagcatttcctgccccagttgcaatggtcaagctgatggtaacaagttactggccccagtggcgctagcttgtgggatcgatggcagtctgtacgtaggcgatttcaactatgtgcggcggatattcccttctggaaatgtaacaagtgtcttagaactaagaaataaagattttagacatagcagcaacccagctcatagatactaccttgcaacggatccagtcacgggagatctgtacgtttctgacacaaacacccgcagaatttatcgcccaaagtcacttacgggggcaaaagacttgactaaaaatgcagaagtcgtcgcagggacaggggagcaatgccttccgtttgacgaggcgagatgtggggatggagggaaggccgtggaagccacactcatgagtcccaaaggaatggcagttgataagaatggattaatctactttgttgatggaaccatgattaggaaagttgaccaaaatggaatcatatcaactcttctgggctctaacgatttgacttcagccagacctttaacttgtgacaccagcatgcacatcagccaggtacgtctggaatggcccactgacctagccattaaccctatggataactccatttatgtcctggataataatgtagttttacagatcactgaaaatcgtcaagttcgcattgctgctggacggcccatgcactgtcaggttcccggagtggaatatcctgtggggaagcacgcggtgcagacaacactggaatcagccactgccattgctgtgtcctacagtggggtcctgtacattactgaaactgatgagaagaaaattaaccggataaggcaggtcacaacagatggagaaatctccttagtggccggaataccttcagagtgtgactgcaaaaatgatgccaactgtgactgttaccagagtggagatggctacgccaaggatgccaaactcagtgccccatcctccctggctgcttctccagatggtacactgtatattgcagatctagggaatatccggatccgggctgtgtcaaagaataagcctttacttaactctatgaacttctatgaagttgcgtctccaactgatcaagaactctacatctttgacatcaatggtactcaccaatatactgtaagtttagtcactggtgattacctttacaattttagctacagcaatgacaatgatattactgctgtgacagacagcaatggcaacacccttagaattagacgggacccaaatcgcatgccagttcgagtggtgtctcctgataaccaagtgatatggttgacaataggaacaaatggatgtttgaaaagcatgactgctcaaggactggaattagttttgtttacttaccatggcaatagtggccttttagccactaaaagtgatgaaactggatggacaacgttttttgactatgacagtgaaggtcgtctgacaaatgttacgtttccaactggagtggtcacaaacctgcatggggacatggacaaggctatcacagtggacattgagtcatctagccgagaagaagatgtcagcatcacttcaaatctgtcctcgatcgattctttctacaccatggttcaagatcagttaagaaacagctaccagattggttatgacggctccctcagaattatctacgccagtggcctggactcacactaccaaacagagccgcacgttctggctggcaccgctaatccgacggttgccaaaagaaacatgactttgcctggcgagaacggtcaaaacttggtggaatggagattccgaaaagagcaagcccaagggaaagtcaatgtctttggccgcaagctcagggttaatggcagaaacctcctttcagttgactttgatcgaacaacaaagacagaaaagatctatgacgaccaccgtaaatttctactgaggatcgcctacgacacgtctgggcacccgactctctggctgccaagcagcaagctgatggccgtcaatgtcacctattcatccacaggtcaaattgccagcatccagcgaggcaccactagcgagaaagtagattatgacggacaggggaggatcgtgtctcgggtctttgctgatggtaaaacatggagttacacatatttagaaaagtccatggttcttctgcttcatagccagcggcagtacatcttcgaatacgatatgtgggaccgcctgtctgccatcaccatgcccagtgtggctcgccacaccatgcagaccatccgatccattggctactaccgcaacatatacaaccccccggaaagcaacgcctccatcatcacggactacaacgaggaagggctgcttctacaaacagctttcttgggtacaagtcggagggtcttattcaaatacagaaggcagactaggctctcagaaattttatatgatagcacaagagtcagttttacctatgatgaaacagcaggagtcctaaagacagtaaacctccagagtgatggttttatttgcaccattagatacaggcaaattggtcccctgattgacaggcagattttccgctttagtgaagatgggatggtaaatgcaagatttgactatagctatgacaacagctttcgagtgaccagcatgcagggtgtgatcaatgaaacgccactgcctattgatctgtatcagtttgatgacatttctggcaaagttgagcagtttggaaagtttggagttatatattatgatattaaccagatcatttctacagctgtaatgacctatacgaagcactttgatgctcatggccgtatcaaggagattcaatatgagatattcaggtcgctcatgtactggattacaattcagtatgataacatgggtcgggtaaccaagagagagattaaaatagggccctttgccaacaccaccaaatatgcttatgaatatgatgttgatggacagctccaaacagtttacctcaatgaaaagataatgtggcggtacaactacgatctgaatggaaacctccatttactgaacccaagtaacagtgcgcgtctgacaccccttcgctatgacctgcgagacagaatcactcgactgggtgatgttcaatatcggttggatgaagatggtttcctacgtcaaaggggcacggaaatctttgaatatagctccaaggggcttctaactcgagtttacagtaaaggcagtggctggacagtgatctaccgttatgacggcctgggaaggcgtgtttctagcaaaaccagtctaggacagcacctgcagtttttttatgctgacttaacttatcccactaggattactcatgtctacaaccattcgagttcagaaattacctccctgtattatgatctccaaggacatctttttgccatggaaatcagcagtggggatgaattctatattgcatcggataacacagggacaccactggctgtgttcagtagcaatgggcttatgctgaaacagattcagtacactgcatatggggaaatctattttgactctaatattgactttcaactggtaattggatttcatggtggcctgtatgacccactcaccaaattaatccactttggagaaagagattatgacattttggcaggacggtggacaacacctgacatagaaatctggaaaagaattgggaaggacccagctccttttaacttgtacatgtttaggaataacaaccctgcaagcaaaatccatgacgtgaaagattacatcacagatgttaacagctggctggtgacatttggtttccatctgcacaatgctattcctggattccctgttcccaaatttgatttaacagaaccttcttacgaacttgtgaagagtcagcagtgggatgatataccgcccatcttcggagtccagcagcaagtggcgcggcaggccaaggccttcctgtcgctggggaagatggccgaggtgcaggtgagccggcgccgggccggcggcgcgcagtcctggctgtggttcgccacggtcaagtcgctgatcggcaagggcgtcatgctggccgtcagccagggccgcgtgcagaccaacgtgctcaacatcgccaacgaggactgcatcaaggtggcggccgtgctcaacaacgccttctacctggagaacctgcacttcaccatcgagggcaaggacacgcactacttcatcaagaccaccacgcccgagagcgacctgggcacgctgcggttgaccagcggccgcaaggcgctggagaacggcatcaacgtgacggtgtcgcagtccaccacggtggtgaacggcaggacgcgcaggttcgcggacgtggagatgcagttcggcgcgctggcgctgcacgtgcgctacggcatgaccctggacgaggagaaggcgcgcatcctggagcaggcgcggcagcgcgcgctcgcccgggcctgggcgcgcgagcagcagcgcgtgcgcgacggcgaggagggcgcgcgcctctggacggagggcgagaagcggcagctgctgagcgccggcaaggtgcagggctacgacgggtactacgtactctcggtggagcagtaccccgagctggccgacagcgccaacaacatccagttcctgcggcagagcgagatcggcaggaggtaacgcccgggccgcgcccgccgagccgctcacgccctgcccacattgtcctgtggcacaacccgagtgggactctccaacgcccaagagccttcctcccgggggaatgagactgctgttacgacccacacccacaccgcgaaaacaaggaccgcttttttccgaatgaccttaaaggtgatcggctttaacgaatatgtttacatatgcatagcgctgcactcagtcggactgaacgtagccagaggaaaaaaaaatcatcaaggacaaaggcctcgacctgttgcgctgggccgtctgttccttctaggcactgtatttaactaacttt

SEQ ID NO: 167 - DNA, 1994 bp, Homo sapiens
gctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctg

SEQ ID NO: 168 - DNA, 3186 bp, Homo sapiens
gtcttttgtggacccgcacaatgatccctgagccagactggattaggatgcctcgcgactaggggtccagagacagaggcctccagttcccaggcacttcgggaagaggaggctgaaatgatgcatcagatttacagctgcagtgacgagaacatagaagttttcaccaccgtgattccttccaaggtatccagtccagccagaagaagagccaaaagctctcagcacctcttgaccaagaatgtggtgatcgagtcggacctgtacacgcaccagcccctggagctgctgccccaccgcggagaccgcagggaccctggcgaccgccgcaggtttgggcggctccagaccgcgcggccgcccacagcccacccggccaaagcctctgccagacccgtggggatttctgaacccaaaacatcaaatctgtgtgggaatcgagcatatggaaaatctctgataccgccagtgccccggatctcagtgaaaacttcagcctctgcctcattggaggcgacagccatgggcacagagaagggagctgttctgatgagaggatccagacatctcaagaagatgactgaagagtatccagcccttccccaaggagcagaagcctctctaccactgacaggcagtgcttcctgcggcgtccccggcatcctccggaaaatgtggacaaggcacaagaagaagtctgaatatgtgggagccaccaacagcgcctttgaggccgactaaaggtgaccctcttcaagtgccctgtgttggccaaggttccccggacaagaggaaaaaccttcaggattgaaactgagccacacgcacctctgctagtagctggtccaaacccattatcctccctcactcattgattaccctgggatagggcacaggaaagaaatgtccctcgaaggcaatataaaactgccccttcttagaattgctaaagccattggtctgaaagtgactttgggaggtcataaagtttgtatctctatctttaagcaaaaaattaaactttcccagctcattttaaagacctccaaggaaggaaaaaagcaattcctctgtcttccttgtgagttgctctaaagtgtgtgattttctagtgtaaatggactttgaggcacttgtaaacacaatggttcttactgtttccattactgcatttacttcaccttgacaaggtacaattttcaaggacaaagcactatatataaagttagtagttctaatatccacttgagagtatactcaagattgattttcatggccatttggcatgattgcatgaattctctattcttttatgtgcagtttttctatagaaaaacattaaaagttaaatgttgactgctaatgttttctgaagtggcatagtctagtggaatcaataatcccttgctttggtataataatttgaacttttgaaagtgctttctcatccgttatctcttatcttcacaaaacccctgtggaagaaagcacaattattcccaatctgcagagggggaaatggaggccttcagagattacaggaccagataccaggtagtggaaccagacagcaggtccttaacttctctccagtggactccctgctttgcctactctctagcaactgacttggggaagtttttaaatggtgagagtgtgtctctgggggcaaccattgaaaagaagactctgatatgttggaacaagtaagggatttgaatgaaatacactattatatcttatacgttagcttgaaccagaaaaagttgacatttttgtaggtcaaaaacaattgagcatcaatttcatatggttcaacctcatatatgatactatgcttttcttctatcagtgaaaatgtcatcatcaattccattgtcaacattagtagccttaaaacaataacataataataatgatgataatgatacttatagctatcatctattaaatgcctatgtttcaggcatgatactaggcaatttatatatatcatcctaatctttctaaaaactctattaggtggccctatccacttaatagatgccaattcaaagaggtttaaatgattagactaaggcacctaacttatgtgagtgtcaggcttcaatgcctgtgttagagctactccttcacacaaaatagttcagaacatagagaaggaccaaggttaataaatgattttcatcccaaacactaaacatgattgatgggtagaggctgcccgaagtactgtgtaaagatggaatctgagatagaagaatgctgtggtcaattagtaattcttgcccatggagggattagtgacacatgccttgtatatttgtcatctgtggcctaaactctgcccctgaaggtttgttttctaattcagaggtttaaattaatctagcccacttaataaaaccagagatcctatgggaaatttagcctaagacagtgctggaaattgccatatgttgatacaaagaagtgtttggccacattacaggtctcagactcaactgctatgtgtgactgccgctctgtgcctatgtcttgcttttttgctgagttccctatttccatatctccaggtgaatccatgagaagcgagagggtggctgagaggcctgggcctctgggattccaccttgctatctctgctcttcaaccattgttttagactctgaacaccagatcctcatatctgaaagtgatttggagacctgggcatcaagtgctcttttaagaaggggctatcccagaggactgttcaaaagtctcattcaatagagatgttggagtccagaacaaagttagggagcaaaccagtaacctatgctggtcgtaacagaggatcctacaattacgtttgtttttaagacaggattttgctgtgttgcccagactggtctcaaactcctgggttcaagagatccatcctcccacctcagtctcctgaaagctgggatgacaggcacatgccaccacacctagctccttacaaccatttattttaacttatttcatttataactggtatctttcatttgtatgtggcagctagagatttatataggatggaagtaatttatttttaatttaaatatttcatgttgaactgtttgccttgtatggaacattttacttggccaattcaaataaaaataaagtcagctttgtttgtgaaaaaaaaaaaaaaaa

SEQ ID NO: 169 - DNA, 528 bp, Homo sapiens
cgccagggagctgtgaggcagtgctgtgtggttcctgccgtccggactctttttcctctactgagattcatctgtgtgaaatatgagttggcgaggaagatcgacctattattggcctagaccaaggcgctatgtacagcctcctgaaatgattgggcctatgcggcccgagcagttcagtgatgaagtggaaccagcaacacctgaagaaggggaaccagcaactcaacgtcaggatcctgcagctgctcaggagggagaggatgagggagcatctgcaggtcaagggccgaagcctgaagctgatagccaggaacagggtcacccacagactgggtgtgagtgtgaagatggtcctgatgggcaggagatggacccgccaaatccagaggaggtgaaaacgcctgaagaaggtgaaaagcaatcacagtgttaaaagaaggcacgttgaaatgatgcaggctgctcctatgttggaaatttgttcattaaaattctcccaataaagctttacagccttctgcaaaa

SEQ ID NO: 170 - DNA, 3363 bp, Homo sapiens
agtgtgggctacccggccactgccctggagctgtggtgactgctgcgtttttctcccatgcacttgcacgtccaggactcctgggagaacttgggccacactccttccttgccctcttgagctcattcgtcaccctgttgggtgagcacagccctagctcaggccactgggcaagccacaccatccaaagaggaggtcctctgccccaggacccccacaccaccccagctccctgttttgctgaggcctggagcccccatggcctcactgagccgagccctacgtgtggctgctgcccaccctcgccagagccctacccggggcatggggccatgcaacctgtccagcgcagctggccccacagccgagaagagtgtgccatatcagcggaccctgaaggagggacagggcacctcggtggtggcccaaggcccaagccggcccctgcccagcacggccaacgtggtggtcattggtggaggcagcttgggctgccagaccctgtaccacctggccaagctgggcatgagtggggcggtgctgctggagcgggagcggctgacctccgggaccacctggcacacggcaggcctgctgtggcagctgcggcccagtgacgtggaggtggagcttctggcccacactcggcgggtggtgagccgggagctggaggaggagacgggactacacacgggctggatccagaatgggggcctcttcatcgcgtccaaccggcagcgcctggacgagtacaagaggctcatgtcgctgggcaaggcgtatggtgtggaatcccatgtgctgagcccggcagagaccaagactctgtacccgctgatgaatgtggacgacctctacgggaccctgtatgtgccgcacgacggtaccatggaccccgctggcacctgtaccaccctcgccagggcagcttctgcccgaggagcacaggtcattgagaactgcccagtgaccggcattcgtgtgtggacggatgattttggggtgcggcgggtcgcgggtgtggagactcagcatggttccatccagacaccctgcgtggtcaactgtgcaggagtgtgggcaagtgctgtgggccggatggctggagtcaaggtcccgctggtggccatgcaccatgcctatgtcgtcaccgagcgcatcgaggggattcagaacatgcccaatgtccgtgatcatgatgcctctgtctacctccgcctccaaggggatgccttgtctgtgggtggctatgaggccaaccccatcttttgggaggaggtgtcagacaagtttgccttcggcctctttgacctggactgggaggtgttcacccagcacattgaaggcgccatcaacagggtccccgtgctggagaagacaggaatcaagtccacggtctgcggccctgaatccttcacgcccgaccacaagcccctgatgggggaggcacctgagctccgagggttcttcctgggctgtggcttcaacagcgcaggaatgatgctgggtggtggctgtgggcaggagctggcccactggatcatccatgggcgcccggagaaggacatgcatggctatgacatcaggcgcttccatcactcgctcacggaccacccccgctggatccgagagcgaagccatgagtcctacgccaagaactactccgtcgtcttcccccacgatgagccgctggccgggcgcaacatgaggagagacccgctgcatgaggaactccttggacaaggctgcgtgttccaggagcggcatggctgggagcgaccgggatggtttcatccccgaggcccagctccggtcctcgagtacgactactacggggcttacgggagccgcgcgcacgaggactacgcctaccgcaggctgctggcagacgagtacaccttcgccttcccgccccaccacgacacgatcaagaaggagtgcctggcctgcagaggggccgccgctgtgtttgacatgtcctacttcgggaagttctacctggtggggctggatgcaaggaaggctgccgactggctcttctccgcagatgtcagccgacccccaggctccaccgtgtacacgtgcatgctcaaccaccgtgggggcaccgagagtgacctgactgtcagccgcctggcacccagccaccaggcctccccgctggcccccgcctttgaaggggacggttactacctggccatgggcggggccgtggcccagcacaactggtcccacatcaccaccgtgctgcaggaccagaagtcccagtgccagctcatcgacagctccgaggacctgggtatgatcagtatccagggcccagccagccgagccattttgcaggaggtgctggacgcagacctgagcaacgaggccttcccgttctccacccacaagctactgagagccgcagggcacctggtccgagccatgcggctgtcctttgtgggggagctgggctgggagctgcacattccaaaggcgtcctgcgtgcctgtgtaccgggctgtgatggccgcgggtgccaagcacggcctcatcaacgcagggtaccgcgccatcgactccctgagcattgagaaaggctaccggcactggcacgcggacctgcggccagacgacagccccctggaggcaggcctggccttcacctgcaagctcaagtcgccggtgcccttcctggggagggaggccctggagcagcagcgggccgcaggcctccgccggcgcctggtgtgcttcaccatggaggacaaagtacccatgtttggcctggaggccatctggaggaacggccaagtggtgggccatgtccggagggctgactttgggttcgccatcgacaagaccatcgcctacggttacatccatgaccccagcggtgggccggtctcgctggactttgtgaagagcggggactatgccctggagagaatgggggtgacctatggtgcccaggctcacctgaagtcgcccttcgaccccaacaacaagagggtgaagggaatctactgagggctcagaccacatgccccatcccatgctgtccatccattctcacaggtcccaaatggccctgggtcccaggaccctggacccagccagaacttgtgccctccctgtccttagcctaggcctagtcctgcgaaaacccccaaaccagatacggacagagaccaagatggcccatcctgtggtcactgactggaaggcagtctctaatccaccccaatcctcccagaaagcaaacctgtaagtgtcttgggctcagggaccatggcttgtagccctttccaagcttctaaaaggtgcttagtaaatacttgataagccccacgtgaaaaaaaaaaaaaaaaaaaaaaa

SEQ ID NO: 171 - DNA, 5223 bp, Homo sapiens
  misc_feature (73)..(73): n is a, c, g, or t
  misc_feature (75)..(75): n is a, c, g, or t
  misc_feature (77)..(77): n is a, c, g, or t
  misc_feature (79)..(80): n is a, c, g, or t
  misc_feature (83)..(84): n is a, c, g, or t
  misc_feature (87)..(87): n is a, c, g, or t
  misc_feature (97)..(97): n is a, c, g, or t
  misc_feature (1438)..(1438): n is a, c, g, or t
  misc_feature (1470)..(1470): n is a, c, g, or t
  misc_feature (2910)..(2910): n is a, c, g, or t
  misc_feature (4965)..(4965): n is a, c, g, or t
  misc_feature (5003)..(5003): n is a, c, g, or t
  misc_feature (5012)..(5012): n is a, c, g, or t
  misc_feature (5023)..(5023): n is a, c, g, or t
  misc_feature (5160)..(5160): n is a, c, g, or t
  misc_feature (5219)..(5219): n is a, c, g, or t
ataaaagaaacaataaatcgttcgaatcaacatgtccgcctttggcacttcggtttgctagctgtttttgtcncnananntannatnaggcaaactnttttttttttttttttttatcaaataaaccttttatttacaggcaaaggatatagtacaagaagaaaaagagaatacagatgacatcgggggtccaagagacattccatatttaagcttcataatgtccttatttgcacacatataccacactgccttcattttctccagctgatagatttgtgtaagaaatcttgactttgagagttcaatgtcattcccaacagggtctttatgtctgtctggtcatgttatcagccagtcttacttaatgtattaggccagttggaaaccatcattaaagaaactgaccctggtgatcaccagagtagtttcagactataaacaacacatcataaatcccactgcccttatcttggcccaaagacaaaactggacattctgatgaccccagagattatgacagtgttttctggtctaattaaaccatagtcttcatatacctttaccacgcctccttcctccaattaggaagctaagtgggtaagaaagaaaaaataaaggcagagcataacgatgtcacccatctttggcctcttagccggagctgatccttacatgggcagtagactataagtgtgttaattatttttcctactgcagagcttcttcacgttggaatggtgaataggtacacatttctcaaagctcaaagtgcaagtctaggtatattctctagtttcaatcttggtgaaatttttttctatgaattcattactttttagtttatttcagggagggggtggtgttttttaatgaattaatacaagtgtcagcatctttcatggacatccagacaatttcttaaagatgggagaggtaaaaaatcttcaggagaaactgtgcctgaactgtgagtatccagaagccattgaccatgttaatggtggagccaatatgaagtacttgctaaatcatgtggtgcgtgaaaggaagagcaatgttataattgcatcctcctaaagactacataaccatcatcactcatcatctctccctggtcccttccacctgccaaacccccataaaaacccataattgatgatacatattagtttataattaacggcgtacctaactgttctctactagtctgagcctctgtacagagaaatgtcagttttgtattcctggttcctggaaaagtacatatagaatagtataaatacaataaatgtttgaattatcgtataacttgagtctaaattttaagttagtatcctgtattaagaactgggttgatcaaatggttctttctttgcacatatcaaggctttcgactattcccaatcaggtcttcccaaatttgggcatattcctngcctctgcctaccctgttctaatttggcactnctaaagatagttcataaaaagcaagccaaagatagaaaagagagctaaggctacaggaggaatttactctttaacatttgggggaaggaaaatgaggcttgtctacagcagggactggctgtcttccagaaatggtttcccaaggtgttccctacctctctttttcttggatatctttttgcattatagatagccttgggaagggtgtcacctttatcctatcagttccacctaatcaactgtagtcatctgagagccagaattattattgatagaggggcctgggaaaggagaaaaggaccaggagagaggaaggtatacttattgcagaggagaaaagccaaagaacgtttgcccatgggcagtcttagctatttaaaatcacccacttcttcatccggctcccttggcatatgtatcagcccatggattgggaggtgtaggaccattctttttctttctggaaggaaagcactgacatttaagcctgtgcggtctgctcaggggctgcccagtttgtccaagctttaggatattagagagattacgcatttgtggtctcaagttaggaaactgttgaagaacaaatatgtcccttattagagggactctttagatgtttagggtactcacaatccttgccaacctgatgtccttggaagctccagtctggctgtaaggagatgatgaggggttctgtgtgttggaggtgatgacctcattgagtctcagccacagcagggcattatgcaggaaagaattcaatggagttatttaatacctttccctattcccacaaaaatctggaactgggttctgaactgagaagtctgggttccctgagaattggacatcagttcaaccacaggaagcctctaaatttagcactctactcacagagggccaagaaaaattcacaaatgtcacaaacttaggaacttaggtatctagtcttctctgtcattttgtaatgagaaactgaggcccataggtaaaacatctcacctccagtcacacaggtaagtacatggcagggcaaggacaggcacccagttttcccaagtccagtggccttttcatgatacccatttctgtgtatcatttcattgattctgtgacagctggccctttgccccacatcaccaaatcttaactctttggactttaataatgtgcaaaattaagaggaagtctggcatcgggagctttacacaactcagagagaactgaggaaagtagttagcatgttaactgtgcctcaccttgacctgaagtgaagagcactcaccaagccacaacctgctatctgcacaccccacaccatgaggtaaaggacagccaaggaagagaaaggaaagaaaagcaatccggcagggagatcagggagcgaaacgaacagagaaacgaacagaggttttttccaagggccttctattttgncttagcgtggtcgcggccgaggtactgagacacattaagaagggcccactgaggccatcattcaccctactctcgggctgcttccatcctccaggcttctagaagttgagaaagtatgagcttcattgttaattatattacagaaaatgggaccagctgggttgcacccactcccctgtgtctggacctcctgcctatgtagcagaaaaggatctttctgctgaattaatattcacctcagagccctgggagatgtctgatgaaaagtagtttttgaagagtcttgtgacaaccagcaatttcggcaaagctatgtcctcaagagtcttccagatttccccaactctacagaatgcttttctttttaaataccataatcccataatctttctcaaaaattataaaactgtattttatttttctcatttatttgggagtttggtaagaaacgtttgggaagaaatgcttttatggagaaactactcagatttgaaactacctagtttatactaccagaagacagagattcaggttagctagtttgctaatcctcacagtttcagagatatgccttgtatttttccagattataggctttgaggacattcaccaatagcatcctcctctgaatgtattttggtccttttgctaagctatgtcttattttatagtcctccaaatgatgatctatgacttctctgcctgctcattagaggaagaaaagctcagatgcattgctaactattatttcaatgccagtggaactggagaaatgcttgaaaaagtaatctcaggttgtaaaaaagaactatctttttttggttgcaggagctagaaccctattattctgagagtaaattttctattattcctatctaattcattttcttgggagatgaaactccctcttttttttggtggggagacagggtctcactttgtcacccaggatgatgatgatggagtgctgtggcacgatcacggcacactgaagcctcgacctcctaggctcaagcgattctctcacctcagcctcctgaatagctgggaccacagacacacaccaccttacccagctaattttttgtatttttttgtagagacagggttttgccgtgttgcccaggctggtctcgaagtcctgggctcaagcgacccgctcaccttggcctcccaaagtgctgggattacaggtgtgagcccctcactgctcctggctccctcattattatatttcctgaagttgacatgatttgggtcctttacttagaaattgtcatcacacaatttcagaaaggtaaagaaatccatttttattggcaactttgggctatgcttcatcctggcaaaaatttaaaagcagtacctgcccgggcggccgctcgaactttcctgcacacctcaggcagcttgtacagactatccaagaaaaaatgaggaggaaagtgctccatcaaggaagagggatgagatgggagcataattcacacactaagaactgagttctaaagtcacttgagctttctggagctcagttacctgtaaaacaaggaagaatgaatggtctttatggaaaatgaatggcagaataagtgatttgtcaagttcattgaactataaattccatttttactgtcatttatttataacaaagttcagatataaagaaaaatctgaacatacagtaggcacagataaacctatagcaaatattcacatgtggtttgaatgcatttattaatctctgtacttattagaattaataataatactaaaatgatttggagaattaatgattaataacagtggaaaatagccttcccattattgttagaggatggtgccatcatgatgctaaatgcctatctgaggggaagctcataaatattacttgacaatattacttgataaatatttgttgaaaaaagaaatgtagtaaagaagcaaggatggctgggcatggtggagcatggctgtggtcccagctaacttgggatgctgaggtgggaggattgtttgagggaagctgagtttgcagtgagccaagattgcacnactgcactgcagcctgggtgacagagtgagaccctctncaaaaaaanaaaaaaaaaanagaaaaagaagcagcagcaacgaaaggagggaggaagggagaaagtttactttgatatgccatatgattgaaacaaatgctcttttttcaaagacaaggattatactcctttgcattccagctactttggtccttgnaacttggtaacctttgccttgaaacaaaaagaatccctggatataatctccttccttgnaatt

SEQ ID NO: 172 - DNA, 3727 bp, Homo sapiens
gcttctctgtggtcttgacaagcgctgcctgggctccgccggctcactaataactgagtgaccttttctttggctgtattatgtctggctgggaagggattgcattttgcagctgagagccggagcttccttcagctcggctcctcgcacgctgctggggtaagttgtcttgaaccaggacggagagagacagcctcggactgcagttgcctaaaaggaggacacctgtggctcagatgcggtcaacaccattgcttggcgtatccttgaggacctcattattttaaacttaaaaaaaaatagacattccctcccccgtcttttttttttttttcaaacaatgcttctttttgacctttcccaaggagaagcgctacaaagcagccactgtgcttactgaacggcctccccctgtatcgcttaattgagaaggtatacaaatgctctcagtccagccagacaccaagccgaaaggttgtgctggctgcaaccgaaagatcaaggaccggtatcttctaaaggcactggacaaatactggcatgaagactgcctgaagtgtgcctgctgtgactgtcgcttgggagaggtgggctccaccctgtacactaaagctaatcttatcctttgtcgcagagactatctgaggctctttggtgtaacgggaaactgcgctgcctgtagtaagctcatccctgcctttgagatggtgatgcgtgccaaggacaatgtttaccacctggactgctttgcatgtcagctttgtaatcagagattttgtgttggagacaaatttttcctaaagaataacatgatcctttgccagacggactacgaggaaggtttaatgaaagaaggttatgcaccccaggttcgctgatctatcaacatcaccccattaagaatacaaagcactacattcttttatcttttttgctccacatgtacataagaattgacacaggaacctactgaatagcgtagatataggaaggcaggatggttatatggaataaaaggcggactgcatctgtatgtagtgaaattgccccagttcagagttgaatgtttattattaaagaaaaaagtaatgtacatatggctggatttttttgcttgctattcgtttttgtgtcacttggcatgagatgtttattttggactattgtatataatgtattgtaatatttgaagcacaaatgtaatacagttttattgtgttaccatttgtgttccatttgcttctttgtattgttgcatttagtacaatcagtgtttaaacttactgtatatttatgctttctgtatttaccagctattttaaatgagctgtaactttctagtaaagaattgaaaagcaaatctcactaatgatacacagatagataaagcaagtctatcaacattaaaaatactaaaaaataaagacacacacagagcattttagtgacatccactacttattgccgctatgagttagagtctatcagtgttcttgttataaccccctattttcagggggttaaaaatcagctttaaaaaaatacataaaaatttcatcttaaagcactttcattttataccaacgtgaaaagtgccatttttagaataactttaaagcttaacaggtttccttttaatatcctttttttgtgtgctctttacttacacaatggctttgttttgctttttcagccacaccccttatgtgaactagtgcctttgggtatcacgtaaaattttttccaaagggttactttaaaaatctgttaccacaattatgagatgatttttaagtgataaattaaacttcttcttgtataaattctgcccagatctctccacaagagctgagggtttcataactttatggcttaataaatgtatgacactgaaaagatttgagtgtgaatctactgaaatcactataatgcacattgaagctatgatggtatttgagtagtgaggttacttttgatcggagcaacataatgctcatagaatcttctagaagaagagaaacaaagggattgataaaatgctgagaactagtgattatatatttttctgtatttacctgacatttattttaatgttcaaaaagtaaacactttaagtttgatgtgttttactctctcattgttttaagtaattgccaactcagaatacatcattcttaggctgaaatttgtctttccattttttaaggtgaaatagtactaccttacgtgatagcatacaaagaagaaagctctagaaagagaaattatggagaatgattatttaaattacaattaaggaaatgagaatatgatcccctcttccgagttgcccacaaacttgcttctttgcttttgctccctgtaatagaactacttttcaacaaatctaattttgcacggcaccgttaaccatattttcactacagcaaacttagtgctatgggttttctttttctttgtttttttcttgatcacttgtataggaaacaatattttccagtgttatttgcatatatattttgtccttccaatatatgcattacagatgaaaattaaatgttatacctgaattcttgggttggggccaaaatattaagctgaaaataatgctggtgtggatttgttttaaaacaaagctttattatgaacatgcatgtgaatctggatattgcctcttatttttaagaaaatggttctgtgaaaagtgaatgatatgtatttttccaaatgcttcatggttaggagtcttcaagttccatgttccccagatttgagatatactaaagaaagaaattcaaaagtagctatttggggcccacaaaaataactattattttagccttagagccttacacttgtttcatgaagagaaaggacttgcataaccaaaataaacaaagcaagacaaattaaaaatatgtgggggagagatcagtgaaaagtggttttcttaatgcagccctgctggtccccattaacaattgcttgaaattcacatggatgtaaaattataattgtcaggatcttattcagatgatcttttaaggtttaactggttttgcttttgtttatctatatgtcaaaatacttgtaaattgggaacaaacttctctcagcttcttgaagttgttcaactatccttgccactggaagaccaaacaaggttttcactgctttttcttttacataatatgctgagaattatttcttatgctttttactacaaacaaaattactcacctggattaaagattaaggccttaatctgtttagattatctttaatctccatgaaatcgtgaaataagacaagaatagtgtttcagctgtaggccattttacagctaattgcccataaattgtagcatttattgacctgaagtactaagctaattgtcttgactactcaaagcccctgaattgttgtcaactttcccctttgtgttgtgtagccctaacgtcatttagcttgttgtctgatgcctccagtaggacacctccgatggagctttgatttctgagcagcgaaagctcccttcctaagatgcatctcgcataggctgcctatgatgaaggaccgtgcacctccactccaacagagtgctgagtttaaaagttgacctgtgtttgtaatttcactttcatcttgcttaataaatatctgctggattctttcattcacttttttacatttggatttatgtttttaataaaaggggtgttacact

SEQ ID NO: 173 - DNA, 2035 bp, Homo sapiens
gaattccgggctccggggatgaggtcgcggccggcgggtcccgcgctgttgctgctgctgctcttcctcggagcggccgagtcggtgcgtcgggcccagcctccgcgccgctacaccccagactggccgagcctggattctcggccgctgccggcctggttcgacgaagccaagttcggggtgttcatccactggggcgtgttctcggtgcccgcctggggcagcgagtggttctggtggcactggcagggcgaggggcggccgcagtaccagcgcttcatgcgcgacaactacccgcccggcttcagctacgccgacttcggaccgcagttcactgcgcgcttcttccacccggaggagtgggccgacctcttccaggccgcgggcgccaagtatgtagttttgacgacaaagcatcacgaaggcttcacaaactggccgagtcctgtgtcttggaactggaactccaaagacgtggggcctcatcgggatttggttggtgaattgggaacagctctccggaagaggaacatccgctatggactataccactcactcttagagtggttccatccactctatctacttgataagaaaaatggcttcaaaacacagcattttgtcagtgcaaaaacaatgccagagctgtacgaccttgttaacagctataaacctgatctgatctggtctgatggggagtgggaatgtcctgatacttactggaactccacaaattttctttcatggctctacaatgacagccctgtcaaggatgaggtggtagtaaatgaccgatggggtcagaactcttcctgtcaccatggaggatactataactgtgaagataaattcaagccacagagcttgccagatcacaagtgggagatgtgcaccagcattgacaagttttcctggggctatcgtcgtgacatggcattgtctgatgttacagaagaatctgaaatcatttcggaactggttcagacagtaagtttgggaggcaactatcttctgaacattggaccaactaaagatggactgattgttcccatcttccaagaaaggcttcttgctgttgggaaatggctgagcatcaatggggaggctatctatgcctccaaaccatggcgggtgcaatgggaaaagaacacaacatctgtatggtatacctcaaagggatcggctgtttatgccatttttctgcactggccagaaaatggagtcttaaaccttgaatcccccataactacctcaactacaaagataacaatgctgggaattcaaggagatctgaagtggtccacagatccagataaaggtctcttcatctctctaccccagttgccaccctctgctgtccccgcagagtttgcttggactataaagctgacaggagtgaagtaatcatttgagtgcaagaagaaagaggcgctgctcactgttttcctgcttcagtttttctcttatagtaccatcactataatcaacgaacttctcttctccacccagagatggcttttccaacacattttaattaaaggaactgagtacattaccctgatgtctaaatggaccaaagatctgagatccattgtgattatatctgtatcaggtcagcagaagaaggaactgagcagttgaactctgagttcatcaattctaatatttggaaattatctacaatggaatcttccctctgttctctgataacctacttgcttactcaatgcctttaagccaagtcaccctgttgcctatgggaggaggtggaaggatttggcaagctcaaccacatgctatttagttagcatcagttgtcaccaacagtctttctgcaaagggcaggagagctttgggggaaaggaaaaggcttaccaggctgctatggtcaactcttcagaaattttcagagcaatctaaaagcgccaaaattcgctatgtttacagtgatactattaagaaaatgaatgtgattctgctctgtctttttaagtatgatcaaataaaaaatttgtacatcacaatcatttctacc

SEQ ID NO: 174 - DNA, 3383 bp, Homo sapiens
cgggggccgcgcgggcaagatggtgtgcgctcgggcggccctcggtcccggcgcgctctgggccgcggcctggggcgtcctgctgctcacagcccctgcgggggcgcagcgtggccggaagaaggtcgtgcacgtgctggagggtgagtcgggctcggtagtggtacagacagcgcctgggcaggtggtaagccaccgtggtggcaccatcgtcttgccctgccgctaccactatgaggcagccgcccacggtcacgacggcgtccggctcaagtggacaaaggtggtggacccgctggccttcaccgacgtcttcgtggcactaggcccccagcaccgggcattcggcagctaccgtgggcgggctgagctgcagggcgacgggcctggggatgcctccctggtcctccgcaacgtcacgctgcaagactacgggcgctatgagtgcgaagtcaccaatgagctggaagatgacgctggcatggtcaagctggacctggaaggcgtggtctttccctaccacccccgtggaggccgatacaagctgaccttcgcggaggcgcagcgcgcgtgcgccgagcaggacggcatcctggcatctgcagaacagctgcacgcggcctggcgcgacggcctggactggtgcaacgcgggctggttgcgcgacggctcagtgcaataccccgtgaaccggccccgggagccctgcggcggcctgggggggaccgggagtgcagggggcggcggtgatgccaacgggggcctgcgcaactacgggtatcgccataacgccgaggaacgctacgacgccttctgcttcacgtccaacctgccggggcgcgtgttcttcctgaagccgctgcgacctgtacccttctccggagctgcgcgcgcgtgtgctgcgcgtggcgcggccgtggccaaggtggggcagctgttcgccgcgtggaagctgcagctgctagaccgctgcaccgcgggttggctggccgatggcagtgcgcgctaccccatcgtgaacccgcgagcgcgctgcggaggccgcaggcctggtgtgcgcagcctcggcttcccggacgccacccgacggctcttcggcgtctactgctaccgcgctccaggagcaccggacccggcacctggcggctggggctggggctgggcgggcggcggcggctgggcagggggcgcgcgcgatcctgctgcctggacccctctgcacgtctaggctgggagtaggcggacagccagggcgcttgaccactggtctagagccctgtggtcccctggagcctggccacgcccttgaagccctggacactggccacattccctgtggtcccttacaaactaactgtgcccctggggtccctgaagactggctagtcctggcagaacagtactttggagttccctggagcctggccagccctcacctcttctggatagaggattcccccaactccccaactttctccatgagggtcacgccccctgaggacctcaggaggccagcagaacccgcaggctcctgaagactggccacgcctcctgagaccacttggaaacagaccaactgcccccgtggtcgcctggtggctggacccccgggattgactagagaccggccgtacaccttctgcatctcactggagactgaacactagtcccttgcggtcacgtgggacactgggcgcctcctcctccccctcctcctcacctggagagactacaggaacttcagggtcactccccgtggtcacatggaggttgtgggccgaggcgcttattttcccttatggtgacctgagtcctggagactcccattctccccctctccctgagagtcccctgcagtttctgggtaacagggcacacccctctagtttcatgggcgagcacccccatctgccacctcagactgacacacagccagctggctcacttactgggggccacgtcccacccctcagatatttctttgaagggagagcaaacccaccctgtcctctgacgtccctttcccaactgtcaccaaacagaccatcttcccaggcctggggaccggtaagatccatgtcactagttatgcagagcagttgccttgggtcccactgtcaccaaggcaaccagtcctgctgctacctgtcacctagagtcacacaccccttccctcatcaggcacacccatgaagacagtgcctccctcctccagctgtaaccatggataccacacatttctcatctcattggcccccaccccagagacctccacctcaacttctggctgtccctaccctgactcaccgccatggagatcaccctccccgaagctgtcgccagggtgacccaacatccagttctccggctctcaccatggaaacaaactgtccctgtccccaggcccactccagttccagaccaccctccatgctccacccccaggcggtttggaccccaccactgttgccatggtgaccaaactctggagtccgaggtaacagaacacctgtccccctaggcttttccttgtggacaacggggccctgttcaccaagctgttgccatagagactgtcaacgttgtcctcatgacaaccagacttccagttctcaggaacttctcattgtgggccagaagtcctgggtgcctcctactagggctaccctactgcaccccatcaggggcctgatggctgccccttccccagacagggctggacttctggagctgctaagccaccctccgtttgcacgttaactctatgccggatagcagctgtgcacgagacaatcttgcaacacccgggcatgtttgtcgtcgtcctacaaatgaggaaaccgagcctatggcgtgccctggtctgttgagatatgcaagcactgagctcctcttttgtcctctgagaccccatctccattctcacccagttcctctctccttccctgacccccacccacatttccctccttagagatccaggagggatggaatgttctttaaaattcaacacccaccaggctctaagcggcgatctgtgctaagaggtcaggacccagccgaagtcctcggcgttgacaggcagctggggggacatgatccatggacaaggccatcccggccgtgggagaccccagtcccgaagtcttgcctgcaggagtactggggtccccctggggccctctttactgtcacgtcatctctaggaaacctatctctgagttttgggaccaggtcggtttgggtttgaattctgcctcttcttgctcactgtgtgaccaagtgacaaactccttctgaacctgtgttctcccactgtaccagggctgttctgtggtccccgtgagtgccaagcatacagtaggggctcaataaatccttgt

SEQ ID NO: 175 - DNA, 1303 bp, Homo sapiens
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcg

SEQ ID NO: 176 - DNA, 1939 bp, Homo sapiens
aatgaccatgtgtagcggagcgaggctggccctgctggtctatgggataatcatgcacagcagcgtctacagctcacctgccgccgccggactccggttccccgggatcaggccagaggaagaggcgtacggcgaggacggaaacccgctgccagacttcggtggctcggagccgccgggcgcagggagccccgcctccgcgccgcgcgccgccgccgcctggtaccgcccggccgggagaagagatgtcgcccacgggatccttaacgaggcctaccgcaaagtgctggaccagctgtccgccgggaagcacctgcagtcgctcgtggcccggggcgtgggtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatccaaacatgtatttatgtaatgaagtaaagccattaaatgaatattttgataataatattgtttttctttctacaaagcactagagaatgcacagatatactttgtggaccaattattgatatatattataaatatatataaagaatatatatatatatatatatataaagtatagagagaagttcatacaaagcgtgcacaaggattgaaaattcgcccgagctgtttatgtttttataaaaataaatagaaaagtagacaatcattgttttgaatattactcctatttttgtaaactggaattaaaaggatagtatttttatccatgacaggcctgaagatattactacttaccatttgctactgtacataaacaatgatgccctgctccagggagattttgaggtaaagatatggagaattgctgaagggcattctttcccagtgagtctctggggcaggctgcttcaatcccagcctaactcaactgggctctgtccccctggttgggtggcaattccaatatttctgctttctttgattctccttttatgtgtagttgtctctcttcagactctcagcccagaagaaaattctcctgataaaacaacagctcgatccaaattgtgcttctccccagaattcacgcctctccctaggagaagagttgaggaactgtacagaaaagggcggcttcgttagaccgctctcttttctgtacttcctgagtggccagggaatctaatatccccaaattagggcaattggaacaaagtgaaggacatagaggtatattggaagaggcagagcctgaggtggtaggaggacgaccctggaaatggactggtttgagattgccccaggtctgggaagctgagggcaaatccagtcccagtggtcctgactttgggcgctgggtattggaaatggatgcaaagtacaatgtgtttttctccagtgctgtccatgcttctcatcttgtgaaatggccaggatcctctcctttgaaacctgctctgtaggagctacccttttcctttgtggttttatggagacctctccttcctaccctcctgcactgtttaagtactgtttaccatttttcattcacttctcttaaacttgtgaatgcttctcacttttttttttgtttgatgcaggcacttattgtaaattttagaaacccctctgtagccactagtaagtaattatgcactaaatatgaaccctttgtttcttgtttattgagtttgtaggtaaaatgtatttttctacattattgcttattgcttagtaaaatttatttcataaaa

SEQ ID NO: 177 - DNA, 6060 bp, Homo sapiens
atggctgaaggtaatggagtcctcgcagaggagctggcctgttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaaggtactgagtggccccatgctggaggccatgtgtgtgtgcgtgtgtgcatatgtgtgtgcatgcacatctgtgtatgtgtatgcatatgtttcatatacaaacaagcaggctgggcagcagtgggcagtgctggaggctggcggtgtgtgtgtctgtgcgaatgtgtgtgtgtgcatgtgtgtgtgtgcacatctgtatgtatatatgtttcatatacaagcaagcaggccgggcagcagtgagcagtgctggaggctgtatatgtgtctgtgtgcgtgcgcatctgtgtatgtgtatatgtttcatgtacaagcaagcaggccgggcagcagtgggcagtgctggaggctctgtgtgtgcgtgtgcatgtgtgtgtatgtatgtgtatgtgttccatttacaagcaagcaggccaggcaactgtgagcagtgctggaggctgtgtgcgcgtgtgtgtgtgtatgtgtatgtgtttcatttacaagcaagcaggccaggcagctgtgagcagtgctggaggctgtgtgtgtgtgtgtgtgagcacgcacgtgtgtgagcacgcacgtgtatgtgtatgtgtgtcatttacaagcaagcaggccaggcagctgtgagcagtgctggaggccgtgtgtgtgtgtgtgtgtgtgtgtgcgcgcgcgcctgtatatgtgtatgtgtttcatttacaagcaagcaggccaggcagctgtgggcagtgctggaggctgtgtgtgtgtgcacgtgtgtgtatgcgtatgtgtttcatttacaagcaagcaggccaggcagctgtgggcagtgctggaggctgtgtgtgtgtgtgtgtgtgtgtgtgtgtatatatgtgtatgtgtatgtgtttcatttacaagcaagcagcccaggcagctgtgggcagtgctggaggctgtgtgtgtgtgtgtgtgtgtgtgtgtatgtgtttcatttacaagtgtgtgtgtgtgtgtgtatgtgtatgtgtatgtgtttcatttacaagcaagcaggccaggcagctgtgggcaatgctggaggctgtgcatcctacctgcatacctgcaaagcctctcactctatagtccctatgcctgtgtcccagaccacacccatacccaagcaggccccaccctggcaacaccagagaggccaaggtctccttgccctctccttgaaggtgtagtgattagaatctcttttatgtgtggcaggcacacagctttgaatgttggaggcgcttggtgacttaaaggaaagctgcagactgataaaaagccaactccctccttctgctccctgtgggccgagcaccccaactgggagggggcagccgaggggagctcccacccaggattgtcaccttcaccccactagagcaccttcaccccactagagcagcctccatacctggaatcctggttgagtgggttttgcactctactcgaggggaggtctgggggtgtcttaacatgacgcatttcagcaatctccagctttcttcctctagcaggaaggtaaggctgtagggctgatctgtgatttagaaggaagggtgtttcaaagcttgtattaaaaaaattacaaacaccaccataaagtgaaatcagctgcactaaatccaagaaggaaatttaggagtcagactcttgtaacccccaggatatcattttgtgactcatcctgggaggatctgagctggttctttgctgtagatttgtacatggagtaaatccggccccatacctggggctctcacttcacaccgattcccaccagggcagccacggctctttttgatggggaagtggatccattccatcccctctctacatccttcagctgtcaacacagcatccgccttgtgggactgttaattactgccttttattatatttacgctgcttaatttttttctccgcaatgtactctttcctctaattaggtgtagtgattagaatctcttttatgtgtggcaggcacgcagctttgaatgttggaggcgcttggtgacttaaaggaaagctgcagactgataaaaagccaacaccctccttctgctccctgtgggccgagcaccccaactgggagggagcagccgatgggagctcccacccaggattgtcagctgaggccccaggaggaaaccttggcttcagactttaggggcgagctatgctgtgcacgtaggaagaaggggtcttacagcaaaggacttgtcagactagccacagaggcactttgcagcttgcccagagccagccactgaacgtttacagggctgcactggcccaagccaaggggtctccttgaagacttcacagcaagccaggacgtcctctacacaaactcagaagacacccagctgggcccttcatgggcctaagcttctgatatataaacatacccgtgtatttacaaacactcccacacaggcccacacaccctcactgacatacactcatggactcacacatacactcacatgcacacatgcatgcacactcacatacactcactcgtgcactcacacatacatgcccacacatagtgacatgctcacacactcatgctttcacatacatacactcactgacatacactcatgtgctcacacgctcatgtactcacattcgtacacacacactgacatatacttacacactcacacttgcacatgcatacacatgcactcacatgcacacatgcatgcacactcatacactcacgcactcaacttgcaggcgtgcacacacatgcccacatactcatgcactcacattcacacatgcgtgcacacatagacgcatgcactcacacatgcatacacacagacatacacatgcactcacattcgtacttgcatacacaccaacacacatatgcacactcacactgacaagcatacacacacactcatgcactcacacccacgcaggcactcacattcacacacatacacactcattgacatacattcattcacatccatgcactcacattcacacatgcatacacactgacattcacacttgcacatgcctacacactcactgacatacacacacacatgcagtcatacacactccctgacatgctcacacactgtcatactcacacactccctgacatgctcacacactgtcacactcacacactcacatacactccctgacatacacactcagacaagtgcccatgcacccacacctatgctcatgcacatgttcccacactctcttataagcatacacacccatgttcctcactcaggacacacatgaatgttccccaggggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtgcatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgatttttttttttttttttttgcacagttaagagaaaaaatcaaacaagcagaaaaaaaaaagaaaaaagacttatcacggt

SEQ ID NO: 178 - DNA, 1358 bp, Homo sapiens
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtgga

SEQ ID NO: 179 - DNA, 579 bp, Homo sapiens
  misc_feature (482)..(482): n is a, c, g, or t
aagtactctccaaagagtaaaaaaaaaaggaacgaatatctcaggctacggttattgtttcctcttttcaagaatgtttcagcaaggcccagaaactgaagtgcctccatcgtagggttcctggcatcctgattagtcacaccttgaaacagtcataatcagaatttagtgagcgttttctaggctccagacactgtctttagaattttgtgtaatactcccaaagattctataaaacaaatactgctcgccatttttaagcattaagaaccgaagttcagagtggttaagaaacgcacccaggggcacatggcatggagagtaaatggcagaatcagaatttggacacaaatttgtttgggtctgaatcctgtgttcttttcattgtatcgagtgtctggcctccttggggagggaggagaactgggctccatttgttacaagtgaatagatctagagatgttattggagcaggagtctgngtggtggagattggaacatgaaacagtgaagcagctcgccttgcagcctctagcagacagcacatgcagagtatgtggaccaattcatagcttctaa

SEQ ID NO: 180 - DNA, 2536 bp, Homo sapiens
aacaacaaaaaccaagcccattttttttccaatcttgtctcatccaaacaggactactaaactgtgatttggctcatctagaatgtaattatttttaatagatagatatcttaaacgtggcgaaaacaataagattgagcttataggcatctggatcattttccctcaactccagttctacaatgactgtgtttcctgtagtacctttccataaactgcttcagagaactgggtaaatcattaaaaatgcaaattcctgggtcctactgcagccctaaggaatttctctttggtgccaaggaaatgcttccttttaacaagagtgcaggtgattctaaaggtaataaagcagtaagtagatatttaagagctagaagtcttaccagagatcattctcaccttccattcaaggggagatatacccaaaccaatagaaggagtaaactacactcagagtcaagatggattgtatggactaaattgaatgaactagacttctctttggaggtccttccttctttaggtcatgaaggaaggatagtttaggtcaacctgctacatcaatagattgggtaaggggaactctcatgggataaaataactaacattgttgagcacttgcgctaatcattttattagatgctctacatttatcatcttcatcaatcctcacatcagccctaggagatactattactgacatctttaataatgacttgatatttaatacattgatattcagttcaaaaattctaaccacaagtttctttcttctccatacctctctaggaacttggtctgcagaccatccagaggaataaaaaggttggccttagtagtcaaaaacaaagctgatagccagacacgttctgatttctgcccttgttccagctttgacgtattatctgttgccttatttctcattgcctcttctacttgtaaaatgcttttcactttctgtctaggttaaagctaaactgaatctatggctttaaataaattaagatcctaaactctctagcttaagtgtaaatgaagtacagtagtttccctactgaaccctacctcttgtgtccctggaaccttctagaacacctgccttctaccctctggttgggagatgcagccaccacatcccttcatatcatactgttttgaataaattttcaaatccttattgttcagagttgtttgggggttctgtctcagagcataaaacctaaaggttatagtagaacaaggcaccttcttaaaagaaatcttgcttcagaccatcagttacagagaatttctaaagtaaaattgaagcaactacaacttctccttagacactttggaatctaaccacttaaggacctttttaaagagatagcttctcttctttctgaagatcaatttctcccaaggccaagattgtccttttctcccatttcttgctagctattgcaaatgagggaagaacattattcatctctcctccccttttttttctgattcttttttcagtcagttttgctcctgggttcaagtagtattaccaccctttcacaagcaacagactctcacagggcaaaaaaaaaaaaaatctaatgattcacagacagatctggagcctctcttcattctcagtaattgctagtcccaagaactagaattgcaaatgggcacaacctatatccttcctgtggaagaggaggccactctcttgagctgaagttccagaagagcagttaatgttcaagagaaattgaactcaactcagcaacaaaggactctattttgaagagcaacatatcacaaagctaaatgtgattgtgccaaacacattaggtgcttatttggggtcatgctaggcctttatcaagtaactggaaaacttttcttgcagccacaatctcaatgtcgttagtaggaagataagaggggagaaaaagctgtagaacaaatgtttggggttaccattgaaaatctaatgtctgcaatatttttctcctcacaacttggaaacgttcccagttcattttcagtcctgttgtgagcacagttctgaagggtttattattgtcaaaataagttttgttttgttttgtttatgttgggtttttaatgttgtctcttgacccttaatgctcaggttcttgtgggagttaatcagccacatccaacgttaccttgagggggaagaagagggtgatgctcagaagctaaacaagacaggggccacatgaccctctattgattagccccaagtagaaagtcctgtggttttatgtttaatggtaatagttgatcatatatggcataattttctatcagcttcctactcagtcactataaacacagacttgaaatagtactttaaatgtccaaatacctaaatgtgctaaactggaggtaactatttctaggtagttgaatttttgaaagtcatgatcagccacacaactgttttgtacatacttattttctcatgcacttttctgtatgcaaataaagctataaatttactcatttcaataaactggagtggcagaat

SEQ ID NO: 181 - DNA, 7770 bp, Homo sapiens
cagagaggaagtagcgagagaagagagaaaatgaagtcggcgctgggggagcctgcaggagggtggccaacagtggaggaaggtggatttggcttcttttccgcaccccgggcgtgaaagccctctccaacgcgaccccaggaaataagtgggtctcgcctgggcagaaaaggaaaagaatccaggcgagagcgcgtcgctcctctgtcactgctgcccccgaggaactccggctgcttctcatcccggccgcctcgcggggccggacgcagtgcccgaggcgccctgcagatggggcgggcagggaacgggcgctccagctgcgggtgacaggcgccggcccgcccgcctgcctgctcagcgcagtgaccgggcgggcagaggatgccaggcggagggacctgggagcgggatctgagactgccggaggcgcgctacgctccaacttgcatggcctagagaccgctccagctcctgggaccgcttcaccgagtggagtgaagctgcgcgcgggacctggaggcggagacctcaggcagcggctgcagaggggcgagccgggcgcaggagggggcgcgctttctccctgcgggtctcagtaatgaggagactgagtttgtggtggctgctgagcagggtctgtctgctgttgccgccgccctgcgcactggtgctggccggggtgcccagctcctcctcgcacccgcagccctgccagatcctcaagcgcatcgggcacgcggtgagggtgggcgcggtgcacttgcagccctggaccaccgccccccgcgcggccagccgcgctccggacgacagccgagcaggagcccagagggatgagccggagccagggactaggcggtccccggcgccctcgccgggcgcacgctggttggggagcaccctgcatggccgggggccgccgggctcccgtaagcccggggagggcgccagggcggaggccctgtggccacgggacgccctcctatttgccgtggacaacctgaaccgcgtggaagggctgctaccctacaacctgtctttggaagtagtgatggccatcgaggcaggcctgggcgatctgccacttttgcccttctcctcccctagttcgccatggagcagtgaccctttctccttcctgcaaagtgtgtgccataccgtggtggtgcaaggggtgtcggcgctgctcgccttcccccagagccagggcgaaatgatggagctcgacttggtcagcttagtcctgcacattccagtgatcagcatcgtgcgccacgagtttccacgggagagtcagaatccccttcacctacaactgagtttagaaaattcattaagttctgatgctgatgtcactgtctcaatcctgaccatgaacaactggtacaattttagcttgttgctgtgccaggaagactggaacatcaccgacttcctcctccttacccagaataattccaagttccaccttggttctatcatcaacatcaccgctaacctcccctccacccaggacctcttgagcttcctacagatccagcttgagagtattaagaacagcacacccacagtggtgatgtttggctgcgacatggaaagtatccggcggattttcgaaattacaacccagtttggggtcatgccccctgaacttcgttgggtgctgggagattcccagaatgtggaggaactgaggacagagggtctgcccttagggctcattgctcatggaaaaacaacacagtctgtctttgagcactacgtacaagatgctatggagctggtcgcaagagctgtagccacagccaccatgatccaaccagaacttgctctcattcccagcacgatgaactgcatggaggtggaaactacaaatctcacttcaggacaatatttatcaaggtttctagccaataccactttcagaggcctcagtggttccatcagagtaaaaggttccaccatcgtcagctcagaaaacaactttttcatctggaatcttcaacatgaccccatgggaaagccaatgtggacccgcttgggcagctggcaggggggaaagattgtcatggactatggaatatggccagagcaggcccagagacacaaaacccacttccaacatccaagtaagctacacttgagagtggttaccctgattgagcatccttttgtcttcacaagggaggtagatgatgaaggcttgtgccctgctggccaactctgtctagaccccatgactaatgactcttccacattggacagcctttttagcagcctccatagcagtaatgatacagtgcccattaaattcaagaagtgctgctatggatattgcattgatctgctggaaaagatagcagaagacatgaactttgacttcgacctctatattgtaggggatggaaagtatggagcatggaaaaatgggcactggactgggctagtgggtgatctcctgagagggactgcccacatggcagtcacttcctttagcatcaatactgcacggagccaggtgatagatttcaccagccctttcttctccaccagcttgggcatcttagtgaggacccgagatacagcagctcccattggagccttcatgtggccactccactggacaatgtggctggggatttttgtggctctgcacatcactgccgtcttcctcactctgtatgaatggaagagtccatttggtttgactcccaaggggcgaaatagaagtaaagtcttctccttttcttcagccttgaacatctgttatgccctcttgtttggcagaacagtggccatcaaacctccaaaatgttggactggaaggtttctaatgaacctttgggccattttctgtatgttttgcctttccacatacacggcaaacttggctgctgtcatggtaggtgagaagatctatgaagagctttctggaatacatgaccccaagttacatcatccttcccaaggattccgctttggaactgtccgagaaagcagtgctgaagattatgtgagacaaagtttcccagagatgcatgaatatatgagaaggtacaatgttccagccacccctgatggagtggagtatctgaagaacgatccagagaaactagacgccttcatcatggacaaagcccttctggattatgaagtgtcaatagatgctgactgcaaacttctcactgtggggaagccatttgccatagaaggatacggcattggcctcccacccaactctccattgaccgccaacatatccgagctaatcagtcaatacaagtcacatgggtttatggatatgctccatgacaagtggtacagggtggttccctgtggcaagagaagttttgctgtcacggagactttgcaaatgggcatcaaacacttctctgggctctttgtgctgctgtgcattggatttggtctgtccattttgaccaccattggtgagcacatagtatacaggctgctgctaccacgaatcaaaaacaaatccaagctgcaatactggctccacaccagccagagattacacagagcaataaatacatcatttatagaggaaaagcagcagcatttcaagaccaaacgtgtggaaaagaggtctaatgtgggaccccgtcagcttaccgtatggaatacttccaatctgagtcatgacaaccgacggaaatacatctttagtgatgaggaaggacaaaaccagctgggcatccagatccaccaggacatccccctccctccaaggagaagagagctccctgccttgcggaccaccaatgggaaagcagactccctaaatgtatctcggaactcagtgatgcaggaactctcagagctcgagaagcagattcaggtgatccgtcaggagctgcagctggctgtgagcaggaaaacggagctggaggagtatcaaaggacaagtcggacttgtgagtcctaggtgaccacactgcttccctttctcagttcctgaccttcctctgagcccttgagacactttgtaatgctcttttgtaactatcgacaaaggtgtggggaagctgaggtctaggtcttcttaaaggtcaagtctgctctccctcgcctaaagtgcagcagcagctcctctcaagctcactctctaggtctccagggtaggagtgtttttctagcaagaatcttagtcaggagtaagctctgtgcgagagatctgtgaataaccagataaccccagctgccgttaaccttttcaccaggtgccacagtaatatttctggtttttagccctttctctgcactaccaacaagagataaaattgttactcacacttatgtcttactgggttgctggttttcatcgtaacacagaacgaggttatctagggttgtagcttttgatacaactccccgatctagatttattcctacattctgaatggggagcaggtaagagcagagcacctcccactgggggtggggtatttaaaaattaactcattagtatcataaacgtcaaggattgattggaccaggcaagagccatgtttttgagaaggttctggatctctgactccatcctgactgtttagtaagagcatgcttacaccctactgtgaaaaggggaggggatgtggtaagcagaaacagaagacaggcagcagaggcattaaaaatgcataccatgctttcagaacaaaagctctgggccagaaaggcaatttggctaaaaaatgaataagactacttctaatgtaactaagcatctccactatggtgtgtgccttttataaaggaaaagagagaaaaaggcaaagcaaggttgtggccttaggttggacctggaatatcccttattgcctataatggaatatgtgacactgtgggtgaaatgttctacacaccacacactaggccattttcagatcagcagtcacccatcgcttagcatagaaatcccaaaacctccagcccgggaacactataagcttcgaccattcaggaatctgccctgcactttgcatatctgtatagaaaatcaagtcaatcccccatcctcacacccactcatctctgaggagctatgaactggttttggtccctctaatgatcctccagcctcatctaatgccccccaaagactgatacaagtaacctcccctctgcttaggtgtcactttctcagcatatcaagtttaggcagcaagggaaaggaatatgggtcagttctcaaatgtcaatgtagataagagtcatctagtagagaactcatcagagtgcggattgccaagacccttctccagagattatggggttgggggtggaggtctagaggtgagctcagaaacctactgttaaccaacacccccaagtgactgacacaggtggtctaaaaattacttttctagaaacaccattctggaagtttggctgcccacaggcaggaggagaagcatgaagagaaaacctgtttgagaagttttgttttgttttgttttgctttttaataattttagcacacatctgctgactctccttcaacatcctcacccccatccctgggcaccatttaggacaagacttccttatttatcaattacttgatttatcttctcaggactcattgttccacccccaaccaatttgaatgcctacaataagttcaggagctgtgccaagcactttcctcttttacagctggagatcactggaaaggtgtctcagtcacaaaacttctccctctactactggatgaaatgtctgcatttccaccaaaatctacccagtcacccagggaataacaacttaagctgtagttagataacacctagtgattaattggctgagaaaaccctggagtggagggaggctcagagatactgatatggatgtgggagggctctaaagttagaggtcaccaactccacagatgaaacagttcaataatgaggaaacaggtgagccctgaaaacacaaaaggacagttctgtgttgaaacaccccatcccctcacgttctcaccccaggcccagaagtaggttgcaactgcctttggaagattttgccccttagccatccccacccacttgtaccagctaagaatgctggagactctgccaccatgctctgcgtgcccctgaacctctgtgcagcccggaaggctgatgtacaggtgtacctcaatccacattacagccatgctcctaatgtacatggacatttttgtaactcagctcatattctgactgtatttgagaagctggctgtttaagggaacccagaagtgaattcttttgtaaagtaaagcacccttttgtaatgcaattaattatcccttaatgtatctgttttgtaagtctgcatttttgtatatcgggtttaccttaagcttctctagtgaggcattctgagcagtggtgatcacatgccagatcgccctgcctatccacaaagtagatgaccaatgcacgctcctcaaacatctttggaggaactacctggccaaaacactggccaggatgcagcaagcagcagcaggggctgacagcaggcttactgccatcaacattgcttgaaatgcctctatgttctgaataaagaaaaaccataattgcttgtggtgaaacgaagcagtcttcatgttaagtagcaatggttatttttattggtagtaactgaacagtgttttgcaatttgtgaaacagtgtattgtgttttgtaaaatgatgtcatgaaatggtgggtccttggaaacctcctttccgttcagctctgcctctgttctttcaactcctttgaggctcaaaaaaaacacaaagatcagaagccttcagatagagggtggtattctggtaaagaagaaagagataagggacgctaccttgcttttctggcacaggaagcacatgataaagcatgctcagaggagctggaacagatatagctacctggttcgtgtaaataagaataatcaaggccccagagtgtgtatgcttccaggtggaggagaaaggggaatctcccaaaatttaaaaacaaattggaagaataaccaggacagccaagtgaagcagccacagggacccaagcagtcgaggtctttaatgtgcctggagatgactctctgctattcatgaatcttgctattgcacaaaccctatcaagagctgctgcttcccttccagccagaaaagtggtaagcggagcaagtgccaagcagaacagaccttatcatctgggtaacagacttctcagtgttggtgctgtgtctgttagagccttagagcaagttaagcacttccttggtgtgggtaaagaataaaggggaaagaaactactttagagcctctttttctcccaactcatatttttgataggaaaaacagaaaacccatccagttcttcagaaattgctttctaggcattaatactactttactatctatactgtttagttattcctttctttacccacctaaactatccatctaatccaggattccctcactctttttttttagttactaatcattttatgaaaataatgtatttataagtattttcttaaggtttgtgaagagtatttgcattgtgtcttcattttaatgtgtttgcaatcgctccgctccaggaagaacggaaatgctgtcttgtgagcatgaagtgaacgggctgttttgctccagccacttttcttgtacaaccacatggatggattagatgtcctcaggtcttttccatcttcagtttctatgactgtggaataaatgttcagatagaaacttc

SEQ ID NO: 182 - DNA, 7129 bp, Homo sapiens
gctggtggcgcccgccagccggcccgggagaggggacttgagcgcttcgcggccggtgcgcagcgcggctccggccccgcagtctgtctgcaagtggccatccccgcccccgactcctgcggccggtgcgggagctgtcagctgcacgttgcgggggtaccggagaagccggggttgccttctcccggttctgtgcgctaaccccggagcccggccccggggaactagggagcgtctccggctgcacagcgctcaggttttagggtttcctttgggccacccaaaatgttttttaaatactttggataagagctaaaccacctgccactggggacttccatactctcggctcccttgtcatctgatggcattttgattgtctcgaggccaagtgacttgctgtccatgatgagtgatgagaagaaccttggtgtgtcccaaaaattggtatcaccttcaaggagcacaagtagctgctcttccaagcaaggaagtcgacaggacagctgggaagtggtggaaggactgaggggggagatgaattacacccaggagccaccagttcagaaaggatttttgctgaaaaagaggaagtggcccttaaaaggctggcataagagattcttctatctggacaaaggaatcttgaaatatgccaagagccaaaccgatatagagagagagaagctgcatggctgcattgatgtcgggctctcagtgatgtctgtaaagaagtcatcaaaatgcatagaccttgacaccgaggagcacatctaccatctgaaggtcaagtcagaagaagtctttgatgagtgggtatcgaaacttcgccaccacagaatgtatcgtcagaatgaaattgccatgtttccacatgaagttaaccactttttctcagggtccaccatcacagactcttcatctggggtgtttgactccatttcaagtaggaagcgtagcagtatatcaaagcagaatttatttcaaactggaagcaatgtatcattttcttgtggtggtgagacacgagttccattatggttacagtcttcagaggacatggaaaaatgctccaaagacctggcgcactgtcatgcctacctggtagaaatgagccagctcctgcaaagcatggacgtcctgcatcggacatactcggcaccagctatcaacgccatccagggtggatcttttgaaagtcccaaaaaggaaaaaagatcgcacaggaggtggcggtccagagctattggcaaagatgctaaaggaacactgcaggtcccgaaacctttttctggcccagtaagactacactcctccaatcctaatttgtcaacactagattttggagaagagaaaaattattctgatggctctgaaacctcatcagagttttctaaaatgcaagaagatctgtgtcatattgcccataaagtttacttcactttaaggtcagcttttaatatcatgtcagcggagagagagaaactgaagcagctgatggagcaggatgcctcctcctccccgtctgctcaggtcattggtctgaagaacgccctgtcatccgccctagcacaaaacacagatcttaaagaacgcttacgcagaatccatgccgagtctctgctcctcgactcccccgctgtcgccaagtcgggtgacaatctggcagaggaaaactccagagatgaaaaccgagctctagttcatcagctttctaatgaaagtagactctccatcactgactccctttctgagttttttgatgctcaggaagttctgttatctccaagctcttcagaaaacgagatttctgatgatgactcatatgtcagtgacataagtgataatctttccttagataatctcagtaatgatttagataatgagagacagaccttggggcctgtccttgatagtggtcgggaagcgaagtcccggagaagaacgtgcctgccggcgccctgcccgagcagcagtaacatcagcctgtggaacatcctgaggaacaacatcgggaaggacctgtccaaggtggccatgccggtggagctgaacgagcccctgaacacgctgcagaggctctgcgaggagctggagtacagcgagctcctggacaaggccgcgcagattcccagccccctggaaaggatggtgaggagtcagccttcccttgccactgtccagcctcggtccccaagccacgaggccattcacggggcccatcagagagacagcccctgttccctccggtttcattttgattgttccgtaaacaggttcattactcagagctgtctggcttcctccgcctggctgtttccagtcaccttgtgaggatttggagacggggttggggtgcttctccgtggcacttggtgcctggggtagttctgttctgtgggtttgtgcttcctctttctccagaagccttctggctgattgttccgatgtgcccggctggaaaacatgtctttagggctgtctgcatgtttatttttacttccctgggtggacagaatttaatttctcgagctgtttttctcatccagggtatatgtggcagcctttgccatatcagcgtatgcatctagctactaccgagctggaagcaagccatttaatccggttcttggagaaacatatgaatgtattcgggaggacaagggcttccagtttttttcagaacaggtcagccaccatccgcctatctctgcgtgtcatgctgagtctagaaattttgttttctggcaagatgtgagatggaaaaacaaattctggggcaaatccatggaaattgttccaattggcacaacccatgtgactctgccagtttttggggatcattttgagtggaacaaagtgacctcttgcatccataacatcttaagcgggcagaggtggattgagcactatggagagattgtcatcaagaacctgcatgatgattcctgctactgcaaagtgaattttataaaggcaaaatactggagcactaatgcccatgagattgaaggcacagtgtttgacaggagtggaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccagaggtttctagaggaagggaacttagaagaagctgaaatacaaaagcagaggattgaacaactgcagagagaaaggcggcgggtcttagaagaaaatcatgtggagcaccagcctcggtttttcaggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttagcattgtaactctttaagtctatattttcctcagtgcgtttctttacaatttcaaatgttaccctgattgtttatatgaatgtagaacaccttgacatttctttttatatataaactatttaataaaaatgaaagattgaatgttcatgtgtgggttaaaaaaagaagctttaacactaattttccaaaggttagggaagattccaattaaatttatgccttataaaattatgttgtagaaaaaaaatcaacctctcccaggtgcattaagaaataagaattcccagggttactcacccatgcgtaagctacccaagtttaatttggtagctgaaatatctttttgcctcagacagctcttgaattgctcatacagaacaattctgctggtgctggagtctgaagaatattttcatttgcattttagtggttagggagaggatataagattaatggaatgtatatttttatataagacgtatacggcaccttcttgaaaaggaagcatttgaacttgttcctccctatagttctattgccttatatgcaaaattgtaccctgttgctcagagaaattattcataagagaaaagaattccaattaattaaatatcacaatagcatcccagagagacagtaggaaatttctccttagtgagagctgagtccttgagaagttaagagactgtttcctgcttcccaccccaccccgttttttgtccctccgtttgatcacctccctgttgagtatggaatgtcccagtttaatataaaacatacagtttattccacacagcagtttgactttgtaaaagtttagcaaaataactgattgttttggataactcaacatgtttttcttaaatgctgttttagtattttctacctcttaataagcaccatattttagatcttgtataaaaagttgccatctgccttatagacaaatgtagagaattgatgttcttgctttgtgttgtgttctggtaaagctttaagtgagtgtcttacccctttcctatactttcttgttatccatatcattcttttgtgagttttgcagcagtcttgaataatacagattataactactgaaaggggaaccttcgtctttttaaatgtgtcatttcacattacaataatatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccagaaaacactttgagatacttaaagaaattcagagcatatcgaatgttatgaatgaagagtaaaataattacaggaaaagaatgcatgatttttcattgtcacaccaaataaccagttggacaatattgcattttcaaaatggagagttatttaaagtggatgtgtagccttctggaatctgcacgtgactggcattttaaaacaactcattaaatattggattcattttatcgagatgccaagatgaacacaatgtgaatatcatttccatttctaagcagttgaatgacacagtcagattctttggtgtatgctttgttctttccatctcaagcatttatccaaattctgctcacagacatgaggaagcaggctgtagatttaagggcactcaaggggaaaacaaatgtagtttccacagtgtgaggataaatgtagaatcgtggtaatattggctgttaaattggcctgctccagagactggctcaaaaaagaaagaagcaacgaaaacaaaatgcacagcctgaatggacgtagcactgtcatgtggcatttggaaaatctttaattatcctaatgttatttcacttgcccttatgctttattttagagtcccagggacaactggatgaaacattacgtctgtagtcatcttatttgagatgggggtgggaacgaattaaaatatgatagagaactatatgcagattttaaaatctagtcagtactagcatctataaagggcttttctgaaatttaaacagcttggtgatgcatcctgatattataagcttaaaactatcttgagggggaaatgacttcttttctccttctgtcccttttctcaaaagcatctttcccccaaatgtatgtctctaggacattttatagttttaagaggaagaaaacagaaacgtggcatcatttgggaagaaccaaggtagaatttaattttctggactttaaatctcctggttaaataatgctaatcactgtaccatttgagttacatgttttaacctcttttttttttctaattattccatccaaaatttctggtgaattacacagaaatttttggaaatgggactttgtgcaggtaaccaccctgcacttcaggtaatgttcctgtcacagctgtcgactaccccacgctgcaggaaatccattcagaaatgagctaacagtctccagtgtagcaggagagccagtcacttccctccccaggccccaaagcaccccaaggctggtattccttgagtcataggtattaataataaaagcctcaatgcagcttctccatgtagttcctctcctacaagccaggtggattctggtcctaactaaagagatgggagttcacctgagggcaagaagtacccaggatgcccaaacagccgcacaggtgtcctgtgcttcctgtgagacttcctgggggaaatatacaaactaatatattttttaatgtttacgtcatttacactgctgcttttctcatattctgcttttaattacttgtagtaaatcatttgtttgggcttcaagcactgtcttccatctgcatcttccagatttatcatgagtgatcttgttctactgttaaagatgtcaagcctaaaaagtaataaagtttttatttggctgttgaaccttgatgtagcccctactacatacactacaagttatgccttctggctactacagaatctccgcagaccttttagttatgagtagaagcaataagaaggtgtccttatggtcttaggaataatagttccaatgtattggcataatttgtttgaatgtctttattttgatattaacaccggcataaatctatttttgctaccagatgatagctattttcatttgctctattttcctctgcattgtactaatctgttactcagtgttagtcttcatttttctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtgaataaataacatggaaaaaaaaaaaaaaaaaaaaaaaaa

SEQ ID NO: 183 - DNA, 9309 bp, Homo sapiens
atgctgccttgtgacttgctggatttggatggccgctcttcggtgaagcaaggaacatccttgctagttcccttctggtccagcactacagaactgcatatcttcagggagtaccattcacattctgtcaccttcctggggaccctccttgtgggagttgaggttttggccattcagatggtctcagtacatctcctggcctcggaggaaaaatgtggctggagtggaggatgcatgatggagctgatgggagaagaggctggaagacatggatcggattccggagggttttgtattaataagccagatcatccgggcggcctgcagaaccacgcgcggctccggacgccgccgccgccgctctcgcacgcccacacccccaaccagcaccacgcggcctccattaactccctgaaccggggcaacttcacgccgaggagcaaccccagcccggcccccacggaccactcgctctccggagagccccctgccggcggcgcccaggagcctgcccacgcccaggagaactggctgctcaacagcaacatccccctggagaccagaaacctaggcaagcagccattcctagggacattgcaggacaacctcattgagatggacattctcggcgcctcccgccatgatggggcttacagtgacgggcacttcctcttcaagcctggaggcacctccccgctcttctgcaccacatcaccagggtacccactgacgtccagcacagtgtactctcctccgccccgacccctgccccgcagcaccttcgcccggccggcctttaacctcaagaagccctccaagtactgtaactggaagtgcgcagccctgagcgccatcgtcatctcagccactctggtcatcctgctggcatactttgtggccatgcacctgtttggcctaaactggcacctgcagccgatggaggggcagatgtatgagatcacggaggacacagccagcagttggcctgtgccaaccgacgtctccctatacccctcagggggcactggcttagagacccctgacaggaaaggcaaaggaaccacagaaggaaagcccagtagtttctttccagaggacagtttcatagattctggagaaattgatgtgggaaggcgagcttcccagaagattcctcctggcactttctggagatctcaagtgttcatagaccatcctgtgcatctgaaattcaatgtgtctctgggaaaggcagccctggttggcatttatggcagaaaaggcctccctccttcacatacacagtttgactttgtggagctgctggatggcaggaggctcctaacccaggaggcgcggagcctagaggggaccccgcgccagtctcggggaactgtgcccccctccagccatgagacaggcttcatccagtatttggattcaggaatctggcacttggctttttacaatgacggaaaggagtcagaagtggtttcctttctcaccactgccattgagtcggtggataactgccccagcaactgctatggcaatggtgactgcatctctgggacctgccactgcttcctgggtttcctgggccccgactgtggcagaggtgagaactctgcattggagctctggatttctgcttcccagacccctcaggcagctcacttctacttctcagagcaagtgcagaatccagcccaccttctgatgcccacgagaagggtttccaagggccattctccagaagcccttggagggagcggaaatggccaatacatgaaaggcagatgcttgtgccacagtggctggaaaggcgctgagtgcgatgtgcccaccaaccagtgtatcgatgtggcctgcagcaaccatggcacctgcatcacgggcacctgcatctgcaaccctggctacaagggcgagagctgtgaggaagtggactgcatggaccccacatgttcaggccggggtgtctgcgtgagaggcgaatgccactgctctgtgggatggggaggcaccaactgcgagacccccagggccacatgcttagaccagtgttcaggccacggaaccttcctcccggacaccgggctttgcagctgtgacccaagctggactggacacgactgttctatcgagatctgtgctgccgactgtggtggccatggcgtgtgcgtagggggcacctgccgctgcgaggatggctggatgggggcagcctgcgaccagcgggcctgccacccgcgctgtgccgagcatgggacctgccgcgacggcaagtgcgagtgcagccctggctggaatggcgaacactgcaccatcgagggttgccctgggttgtgcaatggcaacggcagatgtaccttagacctgaatggttggcactgcgtctgccagctgggctggagaggagctggctgtgacacttccatggagactgcctgcggtgacagcaaagacaatgatggagatggcctggtggactgcatggaccctgactgctgcctccagcccctgtgccatatcaacccgctgtgccttggctcccctaaccctctggacatcatccaggagacacaggtccctgtgtcacagcagaacctacactccttctatgaccgcatcaagttcctcgtgggcagggacagcacgcacataatccccggggagaacccctttgatggagggcatgcttgtgttattcgtggccaagtgatgacatcagatggaacccccctggttggtgtgaacatcagttttgtcaataaccctctctttggatatacaatcagcaggcaagatggcagctttgacttggtgacaaatggcggcatctccatcatcctgcggttcgagcgggcacctttcatcacacaggagcacaccctgtggctgccatgggatcgcttctttgtcatggaaaccatcatcatgagacatgaggagaatgagattcccagctgtgacctgagcaattttgcccgccccaacccagtcgtctctccatccccactgacgtccttcgccagctcctgtgcagagaaaggccccattgtgccggaaattcaggctttgcaggaggaaatctctatctctggctgcaagatgaggctgagctacctgagcagccggacccctggctacaaatctgtcctgaggatcagcctcacccacccgaccatccccttcaacctcatgaaggtgcacctcatggtagcggtggagggccgcctcttcaggaagtggttcgctgcagccccagacctgtcctattatttcatttgggacaagacagacgtctacaaccagaaggtgtttgggctttcagaagcctttgacctgtccgtgactggccaggacctaaaagaatgtgaactgaaagacctgaatgtagaaaacccgaccattacaatgaggctacagaaccaaagggccctgaaaagtgctgtgctggctttttccgtgggttatgaatatgaatcctgcccagatctaatcctgtgggaaaaaagaacaacagtgctgcagggctatgaaattgacgcgtccaagcttggaggatggagcctagacaaacatcatgccctcaacattcaaagtggcatcctgcacaaagggaatggggagaaccagtttgtgtctcagcagcctcctgtcattgggagcatcatgggcaatgggcgccggagaagcatctcctgccccagctgcaacggccttgctgacggcaacaagctcctggccccagtggccctcacctgtggctctgacgggagcctctatgtgggtgatttcaactacattagaaggatcttcccctctggaaatgtcaccaacatcctagagctgagtcacagtccagcacacaaatactacctggccacagaccccatgagtggggccgtcttcctttctgacagcaacagccggcgggtctttaaaatcaagtccactgtggtggtgaaggaccttgtcaagaactctgaggtggttgcggggacaggtgaccagtgcctcccctttgatgacactcgctgcggggatggtgggaaggccacagaagccacactcaccaatcccaggggcattacagtggacaagtttgggctgatctacttcgtggatggcaccatgatcagacgcatcgatcagaatgggatcatctccaccctgctcggctctaatgatctcacatcagcccggccactcagctgtgattctgtcatggatatttcccagacacatttgcgcaggtgtcactggctttcattctcagagcttcctctctactccgctgccccatggggagcagggagtcttcccatcaaggaacgatcttttcatcataacgacaggcagaaaggtctccacaagcaggtccccaagccaaaagctgccacgacactgcccagagagcgaggggagtgtgaagcagcagcactggccggcagcggccctggcgagtttgcaggctccctggctctgcagggacagagggagctgggagttcacctggagtggcccacagacttagccatcaacccaatggacaactcactttatgtcctcgacaacaatgtggtcctgcaaatctctgaaaaccaccaggtgcgcattgtcgccgggaggcccatgcactgccaggtccctggcattgaccacttcctgctaagcaaggtggccatccacgcaaccctggagtcagccaccgctttggctgtttcacacaatggggtcctgtatattgctgagactgatgagaaaaagatcaaccgcatcaggcaggtcaccactagtggagagatctcactcgttgctggggcccccagtggctgtgactgtaaaaatgatgccaactgtgattgtttttctggagacgatggttatgccaaggatgcaaagttaaataccccatcttccttggctgtgtgtgctgatggggagctctacgtggccgaccttgggaacatccgaattcggtttatccggaagaacaagcctttcctcaacacccagaacatgtatgagctgtcttcaccaattgaccaggagctctatctgtttgataccaccggcaagcacctgtacacccaaagcctgcccacaggagactacctgtacaacttcacctacactggggacggcgacatcacactcatcacagacaacaatggcaacatggtaaatgtccgccgagactctactgggatgcccctctggctggtggtcccagatggccaggtgtactgggtgaccatgggcaccaacagtgcactcaagagtgtgaccacacaaggacacgagttggccatgatgacataccatggcaattccggccttctggcaaccaaaagcaatgaaaacggatggacaacattttatgagagctgcagacccaggaatcccagcaagaagccaggcccagctgaaggaagagcctggacagagctgaactctctgacctttcattgccccattgtgaaaaccctcacaggaacccaggggccagctttaccccagaggtacgacagctttggccgcctgacaaatgtgaccttccctactggccaggtgagcagtttccgaagtgatacagacagttcagtgcatgtccaggtagagacctccagcaaggatgatgtcaccataaccaccaacctgtctgcctcaggcgccttctacacactgctgcaagaccaagtccggaacagctactacatcggggccgatggctccttgcggctgctgctggccaacggcatggaggtggcgctgcagactgagccccacttgctggctggcaccgtcaaccccaccgtgggcaagaggaatgtcacgctgcccatcgacaacggcctcaacctggtggagtggcgccagcgcaaagagcaggctcggggccaggtcactgtctttgggcgccggctgcgggtacagctccccttcactagagatcctccagggagaaagggggacagctggctgggtggcaccaccctgaggggagtcacagcgggaccttccaaaagatactttaaaaaggcctctgtcattgttggtggcacagcccctgtatcttcctgtgccctgtctgcaaataacacagcttcagcctccaatgcctctgatttttcatgggaatcatctgccacactgtttttgcatctgcaattgtgtttgattaccccagagaaggttcacaaccgaaatctcctatctctggactttgatcgcgtaacacgcacagagaagatctatgatgaccaccgcaagttcacccttcggattctgtacgaccaggcggggcggcccagcctctggtcacccagcagcaggctgaatggtgtcaacgtgacatactcccctgggggttacattgctggcatccagaggggcatcatgtctgaaagaatggaatacgaccaggcgggccgcatcacatccaggatcttcgctgatgggaagacatggagctacacatacttagagaaggcaggtgtctgtctccctgcatcactggccttgccatacagaaggccaatcattcacggccaagcccagcctggtggcctcagtgggctgtatctgacccatgtcaccaaaaggaaatgttcaggaaagtctgccacagagggcatggggtcccaagaggcatcaggatggatcagggagatagcatggcaggtggtggtcctagggcaggagaacatgaaagacctgcctgatagagtagaggcccaaatactcactggatttgcagagcaggactcggggttcagacccaggccaagggtctgctcccagtccatggtgctgctactacacagccagaggcagtatatctttgagttcgacaagaatgaccgcctctcttctgtgacgatgcccaacgtggcgcggcagacactagagaccatccgctcagtgggctactacagaaacatctatcagccccctgagggcaatgcctcagtcatacaggacttcactgaggatgggcacctccttcacaccttctacctgggcactggccgcagggtgatatacaagtatggcaaactgtcaaagctggcagagacgctctatgacaccaccaaggtcagtttcacctatgacgagacggcaggcatgctgaagaccatcaacctacagaatgagggcttcacctgcaccatccgctaccgtcagattgggcccctgattgaccgacagatcttccgcttcactgaggaaggcatggtcaacgcccgttttgactacaactatgacaacagcttccgggtgaccagcatgcaggctgtgatcaacgagaccccactgcccattgatctctatcgctatgatgatgtgtcaggcaagacagagcagtttgggaagtttggtgtcatttactatgacattaaccagatcatcaccacagctgtcatgacccacaccaagcattttgatgcatatggcaggatgaaggaagtgcagtatgagatcttccgctcgctcatgtactggatgaccgtccagtatgataacatggggcgagtagtgaagaaggagctgaaggtaggaccctacgccaataccactcgctactcctatgagtatgatgctgacggccagctgcagacagtctccatcaatgacaagccactctggcgctacagctacgacctcaatgggaacctgcacttactgagccctgggaacagtgcacggctcacaccactacggtatgacatccgcgaccgcatcactcggctgggtgacgtgcaatacaagatggatgaggatggcttcctgaggcagcggggcggtgatatctttgagtacaactcagctggcctgctcatcaaggcctacaaccgggctggcagctggagtgtcaggtaccgctacgatggcctggggcggcgcgtgtccagcaagagcagccacagccaccacctgcagttcttctatgcagacctgaccaaccccaccaaggtcacccacctgtacaaccactccagctctgagatcacctccctctactacgacttgcaaggacacctctttgccatggagctgagcagtggtgatgagttttacatagcttgtgacaacatcgggacccctcttgctgtctttagtggaacaggtttgatgatcaagcaaatcctgtacacagcctatggggagatctacatggataccaaccccaactttcagatcatcataggctaccatggtggcctctatgatccactcaccaagcttgtccacatgggccggcgagattatgatgtgctggccggacgctggactagcccagaccacgagctgtggaagcaccttagtagcagcaacgtcatgccttttaatctctatatgttcaaaaacaacaaccccatcagcaactcccaggacatcaagtgcttcatgacagatgttaacagctggctgctcacctttggattccagctacacaacgtgatccctggttatcccaaaccagacatggatgccatggaaccctcctacgagctcatccacacacagatgaaaacgcaggagtgggacaacagcaagtctatcctcggggtacagtgtgaagtacagaagcagctcaaggcctttgtcaccttagaacggtttgaccagctctatggctccacaatcaccagctgccagcaggctccaaagaccaagaagtttgcatccagcggctcagtctttggcaagggggtcaagtttgccttgaaggatggccgagtgaccacagacatcatcagtgtggccaatgaggatgggcgaagggttgctgccatcttgaaccatgcccactacctagagaacctgcacttcaccattgatggggtggatacccattactttgtgaaaccaggaccttcagaaggtgacctggccatcctgggcctcagtggggggcggcgaaccctggagaatggggtcaacgtcactgtgtcccagatcaacacagtacttaatggcaggactagacgctacacagacatccagctccagtacggggcactgtgcttgaacacacgctacgggacaacgttggatgaggagaaggcacgggtcctggagctggcccggcagagagccgtgcgccaagcgtgggcccgcgagcagcagagactgcgggaaggggaggaaggcctgcgggcctggacagagggggagaagcagcaggtgctgagcacagggcgggtgcaaggctacgacggctttttcgtgatctctgtcgagcagtacccagaactgtcagacagcgccaacaacatccacttcatgagacagagcgagatgggccggaggtga

SEQ ID NO: 184 - DNA, 504 bp, Homo sapiens
ttaccaaaaatacaattatgctgcatgcatgtttggtctatttgatttccatttaacaatatattatgaaactttgtctgtgccccaaatatattatattagcctatcatcattaatgacccatatatacacatatattgcccacaatttatcaagtcaaccaaaataagcatggactggatgtgtatgtatgtttgtttaaaaataaagaatgttctccttcaactatgaataacttcagaagttagagtaatgctgctttgaaaataacactattttctactatgatagaacttatctttgaagaaaaactgaatccccattttcatgaatatcatacctttctgagaaactatgacacatacataattagttacgaatacagactctcagaatttgaatttcaattctcattacagtaagcctctgttattgtaactggaacatggttgaatattgaactggataagaagaaatagaagaacaaaaagaaacaggacactg

SEQ ID NO: 185 - DNA, 2486 bp, Homo sapiens
ccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagtagctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatctctgcgcgtgggggggctctaactgcactttcggcccttttgctcgtggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggcccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgtt

SEQ ID NO: 186 - DNA, 2927 bp, Homo sapiens
cgcgtgcatcagcctctctggcgggggattctccccggactccggccagcgccaatcaggtcgcgcggtacctgcccccagccctggccacctggaggggcgatgaggctccacgcccggagcagggcagtcctcggagcgccggggaggccgcggagcctcacgtgtgccgccccagccgctggcgcccggaaggacgcgctgcgaccccgtgggagccgaacgcgggagtcgctgcccgagcggagctgctcagccgcgggactgatgcccttggccagacgcacccccaactgctgtctgctcaggtgtagcccgcgtgactgagtcaccgctgctccagctgtttcacgtcgccgttccctttactgaatagtttgatggggcgccgggcggatgacagcgggaacggttgtgatcactggcggaatcctagctacggtgatcctcctctgcatcattgccgtcctgtgctactgcaggctccagtattactgctgcaagaagagcggaaccgaggttgcagacgaggaggaggagcgggagcacgaccttcccacgcatcccagaggccccacctgcaatgcctgcagctcccaagccctggacggcagaggcagcctggcgcctctcaccagcgagccctgcagccagccctgtggggtggccgcgagccactgcactacctgctccccatacagctcccccttttacatacggacggctgacatggtgcccaatgggggtggaggcgagaggctctcctttgctcccacatactacaaagaggggggacccccatccctcaaattggcagcaccccagagttacccggtgacctggccaggctctgggcgtgaggccttcaccaatccaagggctattagtacagacgtgtaaatccttccaccccgacccgcacacacacccacactgctgccctggcgggggccatgggggtgatgaatgaccctccaacagccccacatgggttgtttctgtttctttggcttttctcgctccgcagtggagggtttactaggatttaagcttttgagtgcattgagaaccaagacagggcctggctccaactctgtgggccagaggtgggggactgctaggtcgagtctgcagcttcgccagtttcttggttgggacactcctctggcagccccagcaccaccacaaccccttgcagtgtgccccagtcccctggattcgctggactgcaaaaaggagcaccagggaaagctcagcaaaggctcaggaggcctcccgggtcctcgggagatgaagcatccgtgcctaggaaaaggggacagagggcaaggagagaagtgagagctacaattccagcattggagaagcgaggggcggggcgtcaacggcactgcttcaggacgcgcttgctgaaacgactccaacagctagttcacagcccagctttgtacgttggttaccatagctactgctgtcactgtagctgctcccgtagggtcgttgattcctgaacgtatcacatctcacctgcccccttcctcgtgggacgtgtcaagttgactttaaagcctaaggtggcttgtggggactgcaccagaaagtgtctaaccttgtgttccccgaaatcctttctctgacttaggaaccagcgccccctgctggagaagttttttcattttgttagccgacttctggtagcttagcaaagagaccagctgactgtctctcggcccagcccaccacgccgagtagcttgtgtggatgcagtcctgtgagggtgtgcataaccgttcccaggtgtacgcacgcgcgcgcgcgcgcacagacacacacacacacacacacacacacacacacacacagtaaccacgggtaggcaccaggggctttgtacattcaggagctgcagagaggaaaggtctcccatgtaccagagaaggaaaagtctgatcccgaaacagcttgaacgaaaggtggttaacacgtgaccaatccccatggcagacagcgggctggtgaacaggaagagcacagaatctctgtggggcgatgctgcagcggctgaaaccacgtcaagtcccccagagcccggcattctatgtaagcatccacctgtgacgccgtggagcaggatcttcattcatctcaccagagcaacagcccagtcctgaggatgggagggacgtgacttagccttgggattccacgctcgccgccctcccttggccgccctactccccagtttcctggcgatgagccatttattgtgtctcacaccagcctcatttccaactccgacttcctacttagaatgtggcagtggctttgtgagtgagaatcctgatgagttttccagtggcctctgcagaagctggcccccttctaagggcatagctaacccccttcccactcctgagtcactgaattcgaggagggtggggcagggaaagggctggcccccctgctgaaatcttgattctgcatttgaggaaggtcagggtgccgctgggggagcagggagcggggagggaggaagaggggaatgcacatcttttgcgccactattaaggcacctgtcaccttacatctcaatctggaatcaaagtgccctgggttgagaagcagacctgggctctggtcacactttggtcactcattagctctaggaccagtcactaatctctgagactccattttctccagggaaacgaggcttgcccagatagactaacaaccctttagtgctccaagaagtgagaatttccgaaaaagatctgccggcccagagcactccctcttgccctaatcctggcagggtctggatgtatttacccaactctgatcttgcgtgcagggatgcttgctgatggatgaaagaccacaataaaacaagattagcagcaaaacaaaaaaaaaaaaaaaaaaaa

SEQ ID NO: 187 - DNA, 2356 bp, Homo sapiens
gacacacgcgaggcgctgtcctttcagcaccacaagctcgggctgaggagggaggactcctggccgtcctcctcctcttcaaattggcttgaatcttctctgaccccccacgagtgcagcacagtctgggaagaaaggcgtaaggatggtgaagctgaacagtaaccccagcgagaagggaaccaagccgccttcagttgaggatggcttccagaccgtccctctcatcactcccttggaggttaatcacttacagctgcctgctccagaaaaggtgattgtgaagacaagaacggaatatcagccggaacagaagaacaaagggaagttccgggtgccgaaaatcgctgaatttacggtcaccatccttgtcagcctggccctagctttccttgcgtgcatcgtgttcctggtggtttacaaagccttcacctatgatcacagctgcccagagggattcgtctataagcacaaacgctgtatcccagcctccctggatgcttactactcctcccaggaccccaattccagaagccgcttctacacagtcatcagccactacagcgtggccaagcagagcactgcccgggccatcgggccgtggctgtcagcagccgctgtcatccatgagcccaagccgcccaagacccagggccactagaggcctgccccagccagaatggggggcggggtggagaggaggacccccattggctaagccaagctccagttacaagacaacactgtactcctgggatatgggggcgggggcggggcagggcagggtggggggaagaacgcaccaaaaacgtggtgtgtgctggagttgtctgaaccgatatttctttttgttccttggtattgttgattcgtcgccgagtcaggctcatgtacaaaggcatgtttcgtgttgattgttcccatgtaagatatttttaaagccactgcttattctttgttaggaaaatgtaacagcagaaaaggaaagaaacaaagaacatgaacaaaaagcattaaactggctccatcggaagacgttgaagggcagtgaagagcacagactctgtgggcttcttagataagaaaacgtagcttcagtgggggctccagggttgcagagtatgagtgacacagaccgggactattccattagcctgtggtctgcagggtaggcccgcaggaaatgaggaatggccaagctggagagaagagctgattttggcattactaagcccagaatgcacataacccatagtgaaatgtgctggcctctggtgcattttgcaagatgagcacaaactttctgggcctccatcctaggacctgggcagacccacatggcctgggctctgaatgcccaccctgcgacggtgggttctgcatcagcaaacgctgaggagtgggcagattttctttgtcttttgcttgcattttctagatccacacctggatactgcccatgttgacgagacagcagcagggggagagggagggaaggaaggtgcggctgcaagaaggaaggcacgggacaggcatgtgacactaggccacaagcgataagcacaggcacctgacttttaagtttttgtttgtttgttgtttcccaaagtgctgataacaataacaacaacaataggattccaaccaggagcctcaagtgacagccaggaagagacctgaaggttggggccaccacaatgccaaatcgtttctaaaggaagctgaaaaatgggactgtcttttgcccacttcgttgtgttaaaaggggacatttgtccaaactccccaaccgagttctagaagctcctgacaaggaggcagcatccagccttgaccaggcctcccagttccctggaaccgtatcaggcattcccctgcctctcacaaatgtttcagggaggccagttctgcagggtgtcagctccaggacccacagggccagaaccagctgggagaattggttatttgagatgtggtactgcttcctcacaagtctcccacaggccatgtaaagggtatttttttgtggcttgctgtgttgctgagatcatcgtatgcaacagctgggtaataagactagcatagctcaaactatcctgccaaacgctctcatctgatttttcctcccttctcccccaacctccaatcaccctgagtcacctgtaaattcatttgtcattcaaagcggaataacaagttgtccctagcaaaaccgctgagcgctttataattttgtggtgtatttttgtcagtaggtagcagaggcggaagtattttttggtgtaattcttgaaattttctgacaggaaacaaataaagatagatgtgtctgagaaaaaaaaaaaaaaaaaaaaaa

SEQ ID NO: 188 - DNA, 4045 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaa

SEQ ID NO: 189 - DNA, 1899 bp, Homo sapiens
agcgcgcgactttttgaaagccaggagggttcgaattgcaacggcagctgccgggcgtatgtgttggtgctagaggcagctgcagggtctcgctgggggccgctcgggaccaattttgaagaggtacttggccacgacttattttcacctccgacctttccttccaggcggtgagactctggactgagagtggctttcacaatggaagggatcagtaatttcaagacaccaagcaaattatcagaaaaaaagaaatctgtattatgttcaactccaactataaatatcccggcctctccgtttatgcagaagcttggctttggtactggggtaaatgtgtacctaatgaaaagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggttatcgtgcttttactgaagccaatgatggcagtctgtgtcttgctatggaatatggaggtgaaaagtctctaaatgacttaatagaagaacgatataaagccagccaagatccttttccagcagccataattttaaaagttgctttgaatatggcaagagggttaaagtatctgcaccaagaaaagaaactgcttcatggagacataaagtcttcaaatgttgtaattaaaggcgattttgaaacaattaaaatctgtgatgtaggagtctctctaccactggatgaaaatatgactgtgactgaccctgaggcttgttacattggcacagagccatggaaacccaaagaagctgtggaggagaatggtgttattactgacaaggcagacatatttgcctttggccttactttgtgggaaatgatgactttatcgattccacacattaatctttcaaatgatgatgatgatgaagataaaacttttgatgaaagtgattttgatgatgaagcatactatgcagcgttgggaactaggccacctattaatatggaagaactggatgaatcataccagaaagtaattgaactcttctctgtatgcactaatgaagaccctaaagatcgtccttctgctgcacacattgttgaagctctggaaacagatgtctagtgatcatctcagctgaagtgtggcttgcgtaaataactgtttattccaaaatatttacatagttactatcagtagttattagactctaaaattggcatatttgaggaccatagtttcttgttaacatatggataactatttctaatatgaaatatgcttatattggctataagcacttggaattgtactgggttttctgtaaagttttagaaactagctacataagtactttgatactgctcatgctgacttaaaacactagcagtaaaacgctgtaaactgtaacattaaattgaatgaccattacttttattaatgatctttcttaaatattctatattttaatggatctactgacattagcactttgtacagtacaaaataaagtctacatttgtttaaaacactgaaccttttgctgatgtgtttatcaaatgataactggaagctgaggagaatatgcctcaaaaagagtagctccttggatacttcagactctggttacagattgtcttgatctcttggatctcctcagatctttggtttttgctttaatttattaaatgtattttccatactgagtttaaaatttattaatttgtaccttaagcatttcccagctgtgtaaaaacaataaaactcaaataggatgataaagaataaaggacactttgggtaccagaaaaaaaaaaaaaaaaaaaaaaaaaaaaaaaaaaaaaaaaaaaaaaa

SEQ ID NO: 190 - DNA, 2116 bp, Homo sapiens
atcagaaccaaattgctgagccagtcacctgtgttccaggagccgaatcagaaatgtcatcctcaggcacgccagacttacctgtcctactcaccgatttgaagattcaatatactaagatcttcataaacaatgaatggcatgattcagtgagtggcaagaaatttcctgtctttaatcctgcaactgaggaggagctctgccaggtagaagaaggagataaggaggatgttgacaaggcagtgaaggccgcaagacaggcttttcagattggatccccgtggcgtactatggatgcttccgagagggggcgactattatacaagttggctgatttaatcgaaagagatcgtctgctgctggcgacaatggagtcaatgaatggtggaaaactctattccaatgcatatctgaatgatttagcaggctgcatcaaaacattgcgctactgtgcaggttgggctgacaagatccagggccgtacaataccaattgatggaaatttttttacatatacaagacatgaacctattggtgtatgtggccaaatcattccttggaatttcccgttggttatgctcatttggaagatagggcctgcactgagctgtggaaacacagtggttgtcaaaccagcagagcaaactcctctcactgctctccacgtggcatctttaataaaagaggcagggtttcctcctggagtagtgaatattgttcctggttatgggcctacagcaggggcagccatttcttctcacatggatatagacaaagtagccttcacaggatcaacagaggttggcaagttgatcaaagaagctgccgggaaaagcaatctgaagagggtgaccctggagcttggaggaaagagcccttgcattgtgttagctgatgccgacttggacaatgctgttgaatttgcacaccatggggtattctaccaccagggccagtgttgtatagccgcatccaggatttttgtggaagaatcaatttatgatgagtttgttcgaaggagtgttgagcgggctaagaagtatatccttggaaatcctctgaccccaggagtcactcaaggccctcagattgacaaggaacaatatgataaaatacttgacctcattgagagtgggaagaaagaaggggccaaactggaatgtggaggaggcccgtgggggaataaaggctactttgtccagcccacagtgttctctaatgttacagatgagatgcgcattgccaaagaggagatttttggaccagtgcagcaaatcatgaagtttaaatctttagatgacgtgatcaaaagagcaaacaatactttctatggcttatcagcaggagtgtttaccaaagacattgataaagccataacaatctcctctgctctgcaggcaggaacagtgtgggtgaattgctatggcgtggtaagtgcccagtgcccctttggtggattcaagatgtctggaaatggaagagaactgggagagtacggtttccatgaatatacagaggtcaaaacagtcacagtgaaaatctctcagaagaactcataaagaaaatacaagagtggagagaagctcttcaatagctaagcatctccttacagtcactaatatagtagattttaaagacaaaatttttcttttcttgatttttttaaacataagctaaatcatattagtattaatactacccatagaaaacttgacatgtagcttcttctgaaagaattatttgccttctgaaatgtgacccccaagtcctatcctaaataaaaaaagacaaattcggatgtatgatctctctagctttgtcatagttatgtgattttcctttgtagctacttttgcaggataataattttatagaaaaggaacagttgcatttagcttctttcccttagtgactcttgaagtacttaacatacacgttaactgcagagtaaattgctctgttcccagtagttataaagtccttggactgttttgaaaagtttcctaggatgtcatgtctgcttgtcaaaagaaataatccctgtaatatttagctgtaaactgaatataaagcttaataaaaacaaccttgcatgaaaaaaaaaaaaaaaaaaaaa

SEQ ID NO: 191 - DNA, 3277 bp, Homo sapiens
  misc_feature (156)..(156): n is a, c, g, or t
ggtgatgagcccttgggttctcgctccgactgctaaattcgcttggccgggtccaccttctcgtggcctcactcgccacacggatcagaatccggagcaggcagttctctctattctgaggctcctgcggctgccgcgctgacttccctgtgtggnggagggaactctgggcaggctggttttcttggaatgtgtttacgatgttgaatgggacttgaacaggaagctggacgctgcagctggaactagcgtgccaagttatttatgattccatctgatatacataggagagaaactgatgaagaattctgatggcaactgtatgatagaagctatataaagtcaagtgtccattttctttcaactatatttgagcatacccaggatttaagtcgtggaactgaacatttatttggctgatcctcatcatgaaccgtgcttttagcaggaagaaagacaaaacatggatgcatacacctgaagctttatcaaaacatttcattccctataatgcaaagtttcttggcagtacagaagtggaacagccaaaaggaacagaagttgtgagagatgctgtaaggaaactaaagtttgcaagacatatcaagaaatctgaaggccagaaaattcctaaagtggagttgcaaatatcaatttatggagtaaaaattctagaacccaaaacaaaggaagttcaacacaattgccagcttcatagaatatctttttgtgcagatgataaaactgacaagaggatattcactttcatatgcaaagattctgagtcaaataaacatttgtgctatgtatttgacagcgaaaagtgtgctgaagagatcactttaacaattggccaagcatttgacctggcatacaggaaatttctagaatcaggaggaaaagatgttgaaacaagaaaacagatcgcagggttacaaaaaagaatccaagacttagaaacagaaaatatggaacttaaaaataaagtacaagatttggaaaaccaactgagaataactcaagtatcagcacctccagcaggcagtatgacacctaagtcgccctccactgacatctttgatatgattccattttctccaatatcacaccagtcttcgatgcctactcgcaatggcacacagccacctccagtacctagtagatctactgagattaaacgggacctgtttggagcagaaccttttgacccatttaactgtggagcagcagatttccctccagatattcaatcaaaattagatgagatgcaggaggggttcaaaatgggactaactcttgaaggcacagtattttgtctcgacccgttagacagtaggtgctgacatcaagaacaagaaatcctgattcatgttaaatgtgtttgtatacacatgtcatttattattattactttaagataggtattattcatgtgtcaatgtttttgaatattttaatattttgaaaattttctcagttaaatttcctcaccttcactattgatctgtaatttttattttaaaaacagcttactgtaaagtagatcatacttttatgttcctttctgtttctactgtagatgaatttgtaattgaaagacatattatacaaatacctgccttgtgtctgagttctatttagttagcatcttgaaatttgtattcattttccagatggctagtttattaatgatttcccaaaagccataccttaaagataactttttaaattctgaagagacatgccaatgtcaaactaaacatgttctgtttttaaaccaacaaacatgttactattcattggacagatatcattttatgtataaatactgttcacatcactgggaaaatgtaaactttaacataatgccacaaggtcactaatttctagcaggtaaaattataaggatataaattccaataataaaccaaatgtatttagagtatttattagtaaatgcaaggtgatgttagttatgatcagttatactctaaatatttaatttgttttataaaggtagtgaaaaaatgaaaatttgctatttattaaaaaacattaaatttcattccaaatgagataagtgatattactataacatctaagcatcatctgatttgatattccctaaaaaacatttggaatatatgctatctatagattcagtatctactacccatatttactttaccaaatatatttctcctcactgcataaggactactcttctcatattttcttctttgatgaagatatttttcaccaaagtttattttgtgatgccctcttggttttgatactttaaaatctgtggcacccgttctacatgaattatcaatatttggtaaattcaatctgtatttgttttgttaaagtcaaaaatctcattttccaaaaaaaaaaaaaaaacccagttactgctcagtttagtcttgaacatgagcaataaaattctcttgcatttcattattgatgtgctgatgaacctggacttttaaaaatatttgtttcctatacctttaccctttacctaacagactaatttgtactcagtaaaacaaaaatttatggtcaaaatttctaacttggttcatcacattataagataaataaattaaattaatgaaaatgtgacttagagtaggggtagccctcaaaaatagatttatcatttactcattggaattttcttcaagtgttaaaggtacattttcactaggaaaagaaatcaaatatgcttatgcaatatatatttgtgtgtttttccttaatgttatatggtatatatgagccttcttgtttagtttcttttatctgctaagttgtaccttaattagagggcaatatatgtttcataaagaagagtctttataattttgtttgtcagatagtattttggaatttgtataataaggatgtttagaagccatataagtggctttttttaacagatagaatttgtatttttattgtactttaaaaagatttatgtaataggtatatatttagtggccatttattatcaatggtaacacaatggagtactaagatggtatttgcacatttaagatatgttactttaccaatttttaatggtaatcaactctgctactggcatgatgaaatagtacataactggtcattaattatgaacatttacttctccagtgcgtttttatgaagatctggttgaaaattgtatttctatgtaaactcaacgatatgtttggttttcctgaaaataaatgattttaaataaaaaaaaaaaaaaaaaaaaaaa

SEQ ID NO: 192 - DNA, 3369 bp, Homo sapiens
agagaagaagcaggcagcttgagacaggtggagctggatcaagctgtgaacgtgatttgctggaagctggtcattagtgttagaaaccccgtcttatttatttcatccttcaccctaccatgattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagcaaaacagaatgcatccatttagagatgacagacgaagtaaatcaattgaagagagagaagaggaatatcagagagtgagggagagaatatttgcacacgattcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttcaaaaaaaaaaaaaaaaaa

SEQ ID NO: 193 - DNA, 3315 bp, Homo sapiens
gaccttccattttggtagcttcaactttgcagctgctgtgtctcttcgtcgtctgggaagaaaactttcacattaagagttgctgatgcggattttctttctttcctctcccggcgttgatgagtgcttggctcctgacagaagggatttggctcccagctttgtagttcggaagaagttgggtctatagatttccccctaactctccattgatgtgttgagcttcagagggaataataactctacgtaaagcatgctggcgtctcaaggagttctcctgcatccttatggcgtgcctatgattgtaccggcagctccttaccttcctggactgattcagggtaatcaggaagcagccgctgcccctgacacaatggctcagccttacgcttcggcccagtttgctcccccgcagaacggtatccccgcggaatacacggcccctcatccccaccccgcgccagagtacacaggccagaccacggttcccgagcacacattaaacctgtaccctcccgcccagacgcactccgagcagagcccggcggacacgagcgctcagaccgtctctggcaccgccacacagacagatgacgcagcaccgacggatggccagccccagacacaaccttctgaaaacacggaaaacaagtctcagcccaagcggctgcatgtctccaatatccccttcaggttccgggatccggacctcagacaaatgtttggtcaatttggtaaaatcttagatgttgaaattatttttaatgagcgaggctcaaagggatttggtttcgtaactttcgaaaatagtgccgatgcggacagggcgagggagaaattacacggcaccgtggtagagggccgtaaaatcgaggtaaataatgccacagcacgtgtaatgacaaataaaaagaccgtcaacccttatacaaatggctggaaattgaatccagttgtgggtgcagtctacagtcccgaattctatgcaggcacggtcctgttgtgccaggccaaccaggagggatcttccatgtacagtgcccccagttcacttgtatatacttctgcaatgccaggcttcccgtatccagcagccaccgccgcggccgcctaccgaggggcgcacctgcgaggccgcggtcgcaccgtgtacaacaccttcagggccgcggcgcccccgcccccgatcccggcctacggcggagtagtgtatcaagagcctgtgtatggcaataaattgctgcagggtggttatgctgcataccgctacgcccagcctacccctgccactgccgctgcctacagtgacagaaatcagttcgtcttcgttgcagcagatgaaatttcttgtaacacctctgcagttacggacgagtttatgctgccgacccctaccaccacgcacttgctccagcccccacctacggcgttggtgccatgaatgcttttgcacctttgactgatgccaagactaggagccatgctgatgatgtgggtctcgttctttcttcattgcaggctagtatataccgagggggatacaaccgttttgctccatactaaatgacaaaaccataaaaaccttccaatgtggggagaaaggaagctttccgaggcctgagtattgcaatacatgcagtagtacatcattttagcaactctaaaaaaaaaaaaaatacaaataaaaaggaaaaaaaatgacattttttatcttatacctcagatattttgttctgtgtattttaatattgtgggtctttaatttctgaaggttccgtagtttggttgctggctgtaggagtttttgtggttgatctagacagatgctagataatgaataaaaactggtttagggccatatccagagtgctatattatgtaaatgaattatatatgctgaatattaagctactggggttatcagctgtttgggaagagtgtaagtgactacagtagtcatttttttctgcacctgcattattttattttgtgaaaggggaggttgggaggggcttaggggattggaactggggtttggctgaaagaaaaaaaaaaaaatgtaactgatgaatctaaacgacccactgcaccaacaatcatttatcaatggttctaagttactcattgccagttcaagccaaaggtcatgttgttaagggggtgcttctagtagcacttgtgcatctgagttgaatgaagctgtgcaaacccaccctttaaaccattccacccggcagtattcagcttcttaaccagtcgctatttaggaaaaaaaacccactagttaggccatcaacaagcattctttttatatttcttccagtataataaattattgatatcactgctgacttttatattatgggagggaaaaaataacattaataaaaaggtgataaaaaagcactgtttctatttttttctttttttccaaaaaaagaaagtaataaaaacttaaattctttgtaccagttaaaaaaaatgtataaaatttacatctgtgcagtggagttgttaagttctagaaacagtctatgaagctttagttttagcctagtagaacaactgttagagacagacgtataatttttatggaattacatgataatcatattcggatttatagaagcattttacaagtattgcaatcattgagtagagataatcatggtattttcatcagcttggtactttttgaaacgtgactgcgttgtgtgaacaatctgcaatttttcagtccgtgagatcctgcccttccacctctttcccatacccccaaggattatctcaaaatgatctctttagttctgtctccaaggcccaggacacttgtcagaaggatgcaaaaaaagaaaaaagtacatccaccctcttaatcccaaaagaacaaagtctccccacctttctcggatgcagggccagagtgacacagccgaaaaattgcagtttgtctgtacttctgtttgaactttccacgttgtcctgtttacaagttaacttaagttggggtatccgtcacgggtcttcctgttttgtatttaaataaaaacaacagcagcaggctgtccctgagtagttttgctgccataggttaagtcctcatgtgtacagtgcaggccctgtggcccgcacttcagtaagttatcaactctcaccgctgtgaacctgccaatccgctgtaacaactctgctttaaaacaaaaccaaacaaaactttaaaaaaaaatgtgtgatccagctttctcttgccatcctatgtgcatgccgtaagatcagttggatattaaaccatcaataaagtttcacaagatttga

SEQ ID NO: 194 - DNA, 1145 bp, Homo sapiens
gctccggccagccgcggtccagagcgcgcgaggttcggggagctccgccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgcccaagtgggccagctgccctcacttctggggtggatgatgtgaccttccttgggggactgcggaagggacgagggttccctggagtcttacggtccaacatcagaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgcccaaatccagccagtcctgccccagcccacccccacattggagccctcctgctgctttggtgcctcaaataaatacagatgtcccc

SEQ ID NO: 195 - DNA, 2884 bp, Homo sapiens
ttcgtggctctctgtgtaactggtttttacttggttacatgccaccaggaactgctgattattttaaagtcctactaccctgcagctcactactttaccttgatttggaagatcatggaatatctatttgaatcctggatgtatttttctcacagtcttcttgcttcctgaaatttcctctggtgttgagggaaagctgagagaatgaaggctctaaatccccagtggaagcatgatatggcgaagcagagctggtgctgaattgttctctctgatggctctatgggagtggatagcactgagtcttcattgctgggttttagcggttgctgctgtttcggatcagcatgccacaagccccttcgactggctcctctctgataagggacccttccatcgctcacaggaatacacagattttgtggacagaagccggcagggatttagcacaagatacaagatatacagggagtttggccgctggaaagtaaataaccttgcagttgagagaagaaatttccttggctctcctctgcctcttgcccctgaattcttccgcaacataagacttttgggacgtcgacctacccttcagcaaatcacagaaaaccttatcaagaaatatgggacacatttcttgctatctgctactctgggaggagaggagtcactcacaatttttgtggacaagcggaagttgagcaaacgagctgaaggaagtgattccaccaccaatagctcttcggtcactctggagacgctacatcagctagccgcttcttatttcattgacagggacagcacccttcggagacttcaccacattcaaattgcatccactgccataaaggtaacagaaacacggactggtcctcttggctgcagtaactatgacaacctagattctgtcagttctgttctggttcagagtcctgagaataagattcagttgcaagggcttcaagtacttctcccagactatcttcaggaacgttttgtacaagcagctttgagctacattgcttgcaattcagagggagagtttatctgcaaggaaaatgactgctggtgtcactgtggtcccaaatttccagaatgcaactgcccctccatggacattcaagccatggaagagaatcttcttcgaataactgaaacctggaaagcttacaacagtgactttgaggaatcagatgaattcaagttatttatgaaaaggctacctatgaattatttcctcaacacatctactataatgcatttgtggacaatggattctaattttcagcgccgttatgaacaactggagaacagcatgaaacaacttttcctaaaggcgcagaaaattgtacacaagctttttagccttagcaagaggtgtcataaacaacccctcatcagcctgccaagacaaagaacctcaacctactggcttactcgcatccagtcttttctctactgcaatgagaacggcctcctaggcagcttttcagaagagacgcactcgtgcacgtgtccgaatgaccaggtggtctgcaccgcgttcctgccctgcacagtgggagacgcctctgcctgcctgacatgcgcaccagacaaccgcacccgctgcggcacctgcaacaccggctacatgctcagccaggggctctgcaagcctgaagtcgccgagtccaccgatcactatattggctttgaaactgacctgcaagatctcgagatgaaatatctgctgcagaaaacggacagacgaatagaagtccatgccatttttatcagcaatgacatgcgcctcaatagctggtttgatccctcctggcgtaagcggatgctcctcaccttgaagagcaataagtacaagtcaagtctggtccatatgattttgggtctctctttacagatttgcttaactaaaaacagcaccttggagccagtgttggctgtttatgtcaatcccttcggaggcagccactctgagagctggtttatgcctgtgaatgaaaacagctttccagactgggagcggactaagttggacctacccctgcagtgttataactggacattaactctggggaacaaatggaagacattttttgagacagtacacatctacctgagaagtcgcatcaagtccaatggtcccaatggtaatgagagcatttactatgaacctctggagtttattgacccttcccggaacctgggctatatgaaaatcaataacattcaagtgtttggctacagcatgcactttgaccctgaagcaattcgggacctgattttgcagctggactacccctatactcagggatcccaggattcagcacttttgcaactactagagatcagagaccgtgtaaataaactctccccacctggtcagcgtcgtctagatcttttctcttgcttgcttcgtcatagactcaagctgtctactagtgaggtggtgaggatccaatctgctctgcaggcgtttaatgccaaattgccaaacacaatggattatgacacgaccaaattatgtagttaaccataaatgtcaagcacaacccaaaatcttgaaggagtttttacagtgcttttgtggaacagtttatgtttggaagagtaaatttaaattgtcttttcaatatctgtcttatatcagtcaataacattggatggcaatttacacacatgaacttgctgacaatgaatatattatacagcagttttggtttatgaatgacataaatactgacaccagtctagaagacattctactttttacaataaatttcatttgtaattttatatgttccgtggcaatgcttttgtgcattacatcctctagagggaacataaaaagataccaataaaattttgtagctgaacagttatt

SEQ ID NO: 196 - DNA, 4594 bp, Homo sapiens
aagcagtcgtatcaacgcagagtggcattatggccgggggcacaccctacttcctcagcttctcgccctcaccctgccaacttccctgcgaggagggacccgccgccagcctgcttcctcgtccgcaggccctgcgctgaacgctgccgcgcccagggttcaccttgcgccgtcgggaaagcccatgaactctccagaaacggcgtaaaggagggtcccgccgcggcgcagggctggggcgcctgggttccccctgggtggagcagcggcagcagagcgggaaagtggtggaggatgatcttgcggccaaaggggacctcggcgcagtaatgtcaacatgatgtttcgctcagatcgaatgtggagctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagcccccaccggttatatcattcagataacatttaacgactttgacattgaagaagctcccaattgcatttatgactcattatcccttgataatggagagagccagactaaattttgtggagcaactgccaaaggcctatcatttaactcaagtgcgaatgagatgcatgtgtccttttcaagtgactttagcatccagaagaaaggtttcaatgccagctacatcagagttgccgtgtccttaaggaatcaaaaggtcattttaccccagacatcagatgcttaccaggtatctgttgcaaaaagcatctctattccagagctcagtgctttcacactctgctttgaagcaaccaaagttggccatgaagacagtgattggacagctttctcctactcaaatgcatccttcacacaattgctcagttttggaaaggccaagagtggctactttctatccatttctgattcaaaatgtttgttgaataatgcattacctgtcaaagaaaaagaagacatttttgcagaaagctttgaacagctctgccttgtttggaataattctttgggctctattggtgtaaatttcaaaagaaactatgaaacagttccatgtgattctaccattagtaaagttattcctgggaatgggaaattgttgttgggctccaatcaaaatgaaattgtctctctaaaaggggacatttataactttcgactttggaattttaccatgaatgccaaaatcctctccaacctcagctgtaatgtgaaagggaatgtagtcgactggcaaaatgacttctggaatatcccaaacctagctctgaaagctgaaagcaacctaagctgtggttcctacctgatcccgctcccagcagcagaactggccagctgtgcagacctggggaccctctgtcaagctactgtaaactctcctagtactacaccacccactgtcaccactaacatgcctgttactaacagaatcgataaacaaaggaatgatggaattatctatagaatatccgtagtgattcagaacatccttcgtcaccctgaggtaaaagtacagagcaaggtggcagaatggctcaattcaaccttccaaaattggaactacacggtttatgtcgttaatatcagttttcacctgagtgctggagaggacaagattaaagtcaagagaagccttgaggatgagccaaggttggtgctttgggcccttctagtttacaatgctaccaacaatactaatttagaaggaaaaatcattcagcagaagctcctaaaaaataatgagtccttggatgaaggcttgaggctacatacagtgaatgtgagacaactgggtcattgtcttgccatggaggaacccaaaggctactactggccatctatccaaccttctgaatacgttcttccttgtccagacaagcctggcttttctgcttctcggatatgtttttacaatgctaccaacccattggtaacctactggggacctgttgatatctccaactgtttaaaagaagcaaatgaagttgctaaccagattttaaatttaactgctgatgggcagaacttaacctcagccaatattaccaacattgtggaacaggtcaaaagaattgtgaataaagaagaaagcattgatataacacttggctcaactctaatgaatatattttctaatatcttaagcagttcagacagtgacttgcttgagtcatcttctgaagctttaaaaacaattgatgaattggccttcaagatagacctaaatagcacatcacatgtgaatattacaactcggaacttggctctcagcgtatcatccctgttaccagggacaaatgcaatttcaaattttagcattggtcttccaagcaataatgaatcgtattcccagatggattttgagagtggacaagtggatccactggcatctgtaattttgcctccaaacttacttgagaatttaagtccagaagattctgtattagttagaagagcacagtttactttcttcaacaaaactggacttttccaggatgtaggaccccaaagaaaaactttagtgagttatgtgatggcgtgcagtattggaaacattactatccagaatctgaaggatcctgttcaaataaaaatcaaacatacaagaactcaggaagtgcatcatcccatctgtgccttctgggatctgaacaaaaacaaaagttttggaggatggaacacgtcaggatgtgttgcacacagagattcagatgcaagtgagacagtctgcctgtgtaaccacttcacacactttggagttctgatggaccttccaagaagtgcctcacagttagatgcaagaaacactaaagtcctcactttcatcagctatattgggtgtggaatatctgctattttttcagcagcaactctcctgacatatgttgcttttgagaaattgcgaagggattatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgttttttctgaacattgccatgttcattgtggtaatggtgcagatctgtgggaggaatggcaagagaagcaaccggaccctgagagaagaagtgttaaggaacctgcgcagtgtggttagcttgacctttctgttgggcatgacatggggttttgcattctttgcctggggacccttaaatatccccttcatgtacctcttctccatcttcaattcattacaaggcttatttatattcatcttccactgtgctatgaaggagaatgttcagaaacagtggcggcggcatctctgctgtggtagatttcggttagcagataactcagattggagtaagacagctaccaatatcatcaagaaaagttctgataatctaggaaaatctttgtcttcaagctccattggttccaactcaacctatcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttccttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaaaaaaaaaaaaaaaaa

SEQ ID NO: 197 - DNA, 5121 bp, Homo sapiens
gcgaggaggaaacggtgccggagcgcgcagggcttgctgccgccaccgccgctgcacaggctgccggagcgagcctgccgcgcgccgccctccccgctctccttcctgggcgagctgcggggatggggcggccgcgggagcccgagcgcgcgcaggaaccgccgccgccgccgcccgcgtctccgttgccgcgcgcctgagccgccgtcgccgccgcgcgccctgcccgggggcggcccccccagccccatggaggtctcccggaggaaggcgccgccgcgccccccgcgccccgcagcgccactgcccctgctcgcctatctgctggcactggcggctcccggccggggcgcggacgagcccgtgtggcggtcggagcaagccatcggagccatcgcggcgagccaggaggacggcgtgtttgtggcgagcggcagctgcctggaccagctggactacagcctggagcacagcctctcgcgcctgtaccgggaccaagcgggcaactgcacagagccggtctcgctggcgccccccgcgcggccccggcccgggagcagcttcagcaagctgctgctgccctaccgcgagggggcggccggcctcggggggctgctgctcaccggctggaccttcgaccggggcgcctgcgaggtgcggcccctgggcaacctgagccgcaactccctgcgcaacggcaccgaggtggtgtcgtgccacccgcagggctcgacggccggcgtggtgtaccgcgcgggccggaacaaccgctggtacctggcggtggccgccacctacgtgctgcctgagccggagacggcgagccgctgcaaccccgcggcatccgaccacgacacggccatcgcgctcaaggacacggaggggcgcagcctggccacgcaggagctggggcgcctcaagctgtgcgagggcgcgggcagcctgcacttcgtggacgcctttctctggaacggcagcatctacttcccctactacccctacaactatacgagcggcgctgccaccggctggcccagcatggcgcgcatcgcgcagagcaccgaggtgctgttccagggccaggcatccctcgactgcggccacggccaccccgacggccgccgcctgctcctctcctccagcctagtggaggccctggacgtctgggcgggagtgttcagcgcggccgctggagagggccaggagcggcgctcccccaccaccacggcgctctgcctcttcagaatgagtgagatccaggcgcgcgccaagagggtcagctgggacttcaagacggccgagagccactgcaaagaaggggatcaacctgaaagagtccaaccaatcgcatcatctaccttgatccattccgacctgacatccgtttatggcaccgtggtaatgaacaggactgttttattcttggggactggagatggccagttacttaaggttattcttggtgagaatttgacttcaaattgtccagaggttatctatgaaattaaagaagagacacctgttttctacaaactcgttcctgatcctgtgaagaatatctacatttatctaacagctgggaaagaggtgaggagaattcgtgttgcaaactgcaataaacataaatcctgttcggagtgtttaacagccacagaccctcactgcggttggtgccattcgctacaaaggtgcacttttcaaggagattgtgtacattcagagaacttagaaaactggctggatatttcgtctggagcaaaaaagtgccctaaaattcagataattcgaagcagtaaagaaaagactacagtgactatggtgggaagcttctctccaagacactcaaagtgcatggtgaagaatgtggactctagcagggagctctgccagaataaaagtcagcccaaccggacctgcacctgtagcatcccaaccagagcaacctacaaagatgtttcagttgtcaacgtgatgttctccttcggttcttggaatttatcagacagattcaactttaccaactgctcatcattaaaagaatgcccagcatgcgtagaaactggctgcgcgtggtgtaaaagtgcaagaaggtgtatccaccccttcacagcttgcgacccttctgattatgagagaaaccaggaacagtgtccagtggctgtcgagaagacatcaggaggaggaagacccaaggagaacaaggggaacagaaccaaccaggctttacaggtcttctacattaagtccattgagccacagaaagtatcgacattagggaaaagcaacgtgatagtaacgggagcaaactttacccgggcatcgaacatcacaatgatcctgaaaggaaccagtacctgtgataaggatgtgatacaggttagccatgtgctaaatgacacccacatgaaattctctcttccatcaagccggaaagaaatgaaggatgtgtgtatccagtttgatggtgggaactgctcttctgtgggatccttatcctacattgctctgccacattgttcccttatatttcctgctaccacctggatcagtggtggtcaaaatataaccatgatgggcagaaattttgatgtaattgacaacttaatcatttcacatgaattaaaaggaaacataaatgtctctgaatattgtgtggcgacttactgcgggtttttagcccccagtttaaagagttcaaaagtgcgcacgaatgtcactgtgaagctgagagtacaagacacctacttggattgtggaaccctgcagtatcgggaggaccccagattcacggggtatcgggtggaatccgaggtggacacagaactggaagtgaaaattcaaaaagaaaatgacaacttcaatatttccaaaaaagacattgaaattactctcttccatggggaaaatgggcaattaaattgcagttttgaaaatattactagaaatcaagatcttaccaccatcctttgcaaaattaaaggcatcaagactgcaagcaccattgccaactcttctaagaaagttcgggtcaagctgggaaacctggagctctacgtcgagcaggagtcagttccttccacatggtattttctgattgtgctccctgtcttgctagtgattgtcatttttgcggccgtgggggtgaccaggcacaaatcgaaggagctgagtcgcaaacagagtcaacaactagaattgctggaaagcgagctccggaaagagatacgtgacggctttgctgagctgcagatggataaattggatgtggttgatagttttggaactgttcccttccttgactacaaacattttgctctgagaactttcttccctgagtcaggtggcttcacccacatcttcactgaagatatgcataacagagacgccaacgacaagaatgaaagtctcacagctttggatgccctaatctgtaataaaagctttcttgttactgtcatccacacccttgaaaagcagaagaacttttctgtgaaggacaggtgtctgtttgcctccttcctaaccattgcactgcaaaccaagctggtctacctgaccagcatcctagaggtgctgaccagggacttgatggaacagtgtagtaacatgcagccgaaactcatgctgagacgcacggagtccgtcgtcgaaaaactcctcacaaactggatgtccgtctgcctttctggatttctccgggagactgtcggagagcccttctatttgctggtgacgactctgaaccagaaaattaacaagggtcccgtggatgtaatcacttgcaaagccctgtacacacttaatgaagactggctgttgtggcaggttccggaattcagtactgtggcattaaacgtcgtctttgaaaaaatcccggaaaacgagagtgcagatgtctgtcggaatatttcagtcaatgttctcgactgtgacaccattggccaagccaaagaaaagattttccaagcattcttaagcaaaaatggctctccttatggacttcagcttaatgaaattggtcttgagcttcaaatgggcacacgacagaaagaacttctggacatcgacagttcctccgtgattcttgaagatggaatcaccaagctaaacaccattggccactatgagatatcaaatggatccactataaaagtctttaagaagatagcaaattttacttcagatgtggagtactcggatgaccactgccatttgattttaccagattcggaagcattccaagatgtgcaaggaaagagacatcgagggaagcacaagttcaaagtaaaagaaatgtatctgacaaagctgctgtcgaccaaggtggcaattcattctgtgcttgaaaaactttttagaagcatttggagtttacccaacagcagagctccatttgctataaaatacttttttgactttttggacgcccaggctgaaaacaaaaaaatcacagatcctgacgtcgtacatatttggaaaacaaacagccttcctcttcgcttctgggtaaacatcctgaagaaccctcagtttgtctttgacattaagaagacaccacatatagacggctgtttgtcagtgattgcccaggcattcatggatgcattttctctcacagagcagcaactagggaaggaagcaccaactaataagcttctctatgccaaggatatcccaacctacaaagaagaagtaaaatcttattacaaagcaatcagggatttgcctccattgtcatcctcagaaatggaagaatttttaactcaggaatctaagaaacatgaaaatgaatttaatgaagaagtggccttgacagaaatttacaaatacatcgtaaaatattttgatgagattctaaataaactagaaagagaacgagggctggaagaagctcagaaacaactcttgcatgtaaaagtcttatttgatgaaaagaagaaatgcaagtggatgtaagcactctggggcctggcttaatctggcaaagttcttcagacgacttgggagcaaaatggctgcttgagctactctgtgtcgttaatttgttgtttgcacataggttccactttgggcactgtctttttaagagaccaaggcacatgcacagcttttagaaagcaa

SEQ ID NO: 198 - DNA, 3132 bp, Homo sapiens
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcgacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgccataaaaaaaaaaaaaaa

SEQ ID NO: 199 - DNA, 4181 bp, Homo sapiens
ggaactccgcttcgcccgagacccagcgcccaggcgtgtcgcccgagaggagccgcgcgaaggtcaccccgcgcccgccgcccgccgcccgccgcctccgtgggtccgtttgccagtcagcccgtgcgtccgagcccctcgcgccccgccgcagccccggccaaccgagcgccatgaaccagatagagcccggcgtgcagtacaactacgtgtacgacgaggatgagtacatgatccaggaggaggagtgggaccgcgacctgctcctggacccagcctgggagaagcagcagaggaagaccttcactgcctggtgtaactcccacctaaggaaagccggcacccagattgagaacatcgaggaagacttcaggaatggccttaagctcatgctgcttttggaagtcatctcaggggaaaggctgcccaaacctgaccggggaaaaatgcggttccacaaaattgctaatgtcaacaaagctttggattacatagccagcaaaggggtgaaactggtgtccatcggcgctgaagaaattgttgatggcaatgtgaaaatgaccctgggtatgatctggaccatcatccttcgctttgctattcaggatatttcggttgaagaaacatctgccaaagaaggtctgctgctttggtgtcagaggaaaactgctccttatagaaatgtgaacattcagaacttccatactagctggaaagatggccttggactctgtgccctcatccaccgacaccggcctgacctcattgactactcaaagcttaacaaggatgaccccataggaaatattaacctggccatggaaatcgctgagaagcacctggatattcctaaaatgttggatgctgaagacatcgtgaacacccctaaacccgatgaaagagccatcatgacgtacgtctcttgcttctaccacgcttttgcgggcgcggagcaggccgagacagcggctaacaggatatgtaaggttcttgctgtgaatcaagagaatgagaggctgatggaagaatatgagaggctagcgagtgagcttttggaatggattcgtcgcacgatcccctggctggagaaccggactcccgagaagaccatgcaagccatgcagaagaagctggaggacttccgggattaccgccggaagcacaagccacccaaggtgcaggagaaatgccagctggagatcaacttcaacacgctgcagaccaagctgcggatcagcaaccgtcctgccttcatgccctccgagggcaagatggtgtcggatattgctggtgcctggcagaggctggagcaggctgagaagggttacgaggagtggttgctcaatgagattcggagactggagcgcttggaacacctggctgagaagttcaggcagaaggcctcaacgcacgagacttgggcttatggcaaagagcagatcttgctgcagaaggattacgagtcggcgtcgctgacagaggtgcgggctctgctgcggaagcacgaggcgttcgagagcgacctggcagcgcaccaggaccgcgtggagcagatcgcagccatcgcgcaggagctcaatgaactggactatcacgacgctgtgaatgtcaatgatcggtgccagaaaatttgtgaccagtgggaccgactgggaacgcttactcagaagaggagagaagccctagagagaatggagaaattgctagaaaccattgatcagcttcacctggagtttgccaagagggctgctcctttcaacaattggatggagggcgctatggaggatctgcaagatatgttcattgtccacagcattgaggagatccagagtctgatcactgcgcatgagcagttcaaggccacgctgcccgaggcggacggagagcggcagtccatcatggccatccagaacgaggtggagaaggtgattcagagctacaacatcagaatcagctcaagcaacccgtacagcactgtcaccatggatgagctccggaccaagtgggacaaggtgaagcaactcgtgcccatccgcgatcaatccctgcaggaggagctggctcgccagcatgctaacgagcgtctgaggcgccagtttgctgcccaagccaatgccattgggccctggatccagaacaagatggaggagattgcccggagctccatccagatcacaggagccctggaagaccagatgaaccagctgaagcagtatgagcacaacatcatcaactataagaacaacatcgacaagctggagggagaccatcagctcatccaggaggcccttgtctttgacaacaagcacacgaactacacgatggagcacattcgtgttggatgggagctgctgctgacaaccatcgccagaaccatcaatgaggtggagactcagatcctgacgagagatgcgaagggcatcacccaggagcagatgaatgagttcagagcctccttcaaccactttgacaggaggaagaatggcctgatggatcatgaggatttcagagcctgcctgatttccatgggttatgacctgggtgaagccgaatttgcccgcattatgaccctggtagatcccaacgggcaaggcaccgtcaccttccaatccttcatcgacttcatgactagagagacggctgacaccgacactgccgagcaggtcatcgcctccttccggatcctggcttctgataagccatacatcctggcggaggagctgcgtcgggagctgcccccggatcaggcccagtactgcatcaagaggatgcccgcctactcgggcccaggcagtgtgcctggtgcactggattacgctgcgttctcttccgcactctacggggagagcgatctgtgatgctgagcttctgtaatcactcatcccatcagaatgcaataaaagcggaagtcacagtttgtttcctggaaactttgacaagctttattaagttgagagagagagagggggaaaaaaaaaaagcctttcgtagttcagtaattgccagcaatataacacggctaaaatgaagtttttacagtatatgacatagtgcgcttcataaataggtttatttctgagtttttagcaaaatgtaatgaaatatcaggttgatttctttgattaaacagaacaaattacttgagtaataggaaattaggaggatctagggacagaaggaaagtgaaaaatgtgaaaatacaaaatacccaagatttaagaccggggggaaaaaaccacaaattggtaaataaaggtttgctatttgtaaaaaatttcatttatctctaatatgcttatgtgattggccctaggggagtatatttgggattctaatgttttattttcatgcttatccaaagattactattgtatcttcaaatgaacttaatattgtgagatggaactgccggggattaaaaagactacccaaaagatttttggcacttacaatttttaaaatagtttatgtcatctcttcattatttagggctggatggtcaactcagtcagtgattttttgatgcttctcttatcctccagaatagagacctaaggacacgtggaagtcagtttaattgccagagagaaggatgcaatcactaggtgaaatgaggtttttaggattatttattgattccaggttcccatgctttttgttagagcttattagtacaggttctcaagagatgaccacataaaagtgctctgtttataaataagcaggtttctgtagtactgactggttcatcacaaggcaagtcagaaaccagtatccttctagctctccagtcaggacttccttatgcctctagttttatgaccggttaaggagaagccagagttagagtaggagaggactaattctcagcagcagtggaggtgagttctttcttttgcggaagctttacatatgttttgtgtagtaggaataactagatattttagctagtgtgcggtgtgtgttcacccctgggattggacagtgtatcctaacaagtcccatgtctggttctgtgtctaaaggcctgctccatgacacaggatgctacatgcactcctgctagcacatcttgatctgttgaatgttcattctttctttttgctcatactgctgtaggctataattcccccctgtttttccatcttgttgacagcttgtagagaataaagcaggaattc

SEQ ID NO: 200 - DNA, 2189 bp, Homo sapiens
gcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaacttttttatgcttaccatcttttttttttctttaacagatttgtatttaagaattgtttttaaaaaattttaagatttacacaatgtttctctgtaaatattgccattaaatgtaaataactttaataaaacgtttatagcagttacacagaatttcaatcctagtatatagtacctagtattataggtactataaaccctaattttttttatttaagtacattttgctttttaaagttgatttttttctattgtttttagaaaaaataaaataactggcaaatatatcattgagccaaaaaaaaaaaaaaaaaaaaa

SEQ ID NO: 201 - DNA, 5067 bp, Homo sapiens
atgaggataatcatctgcccctttagcaccaatcactttttcaattactgcgtcaccctctcgccaagggtcccccagacgggcgggggctccttgcggccggctagctactctccccgcctccctgcgccctcgccctccgccccgctgtacccgcagagcgcgcggcccagcgcagccccttttggcaccgaggtttccaggtgcccagcgcgaaggcggagccgggttacagccgcctcctcggcgccacagagaagacccccgggagttcggcggcccaggcgctccggctctgcgtcccgagcctcccccggctctccgcgctcctccctctcggcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagagaagccgtgtggagacccgccttcgttcccacacaccatcctgcagggccgcaccggcttggaaatgggggatgaactgctgtacgtgtgtgccccaggccacatcatgggccaccgggagaccgccttcaccttgctatgtaacagctgtggggagtggtacggcctggtgcaggcctgtgggaaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaaaggaggtggatgatgacaccaaaaagcagttttctgctggagacaaccacagtggtgtaaaattggtcccaggtgaacctgaaaccaaggtgatctacggcaacactgatggtccctcggggccatttgtgggcaagaatgacagcaaggcaggagatccagtggtgagcagcagtgatgagtcctggttagatggctaccctgtgacagagggggcttggaggaagacagaggcagaagaggaagaagatggggacagaggggatgggtcagtagggctggatgaaaacgtcctagttactcctgatcagcccattcttgtggaagttaagaagcccaagagtagcaccctcacaccaagcgagggcatgacccatagttcagttcttccatctcaaatgctagatgtggaagctttggcgctcagacccgtgaatgcttccgagactgagggcattggggatggtgacttgacgaagtaccagtcaactctaccctggagattcatcacagaggaatctcccatggccaccctgtcctatgagctcaccagctccaccctggagatattaacagtgaacactgtcaagcagacacctaaccacatcccctcaacgatcatggcaaccacccagcctccagtagaaaccactgttcctgagatccaggatagcttcccatacctgctgtctgaagacttctttggacaggaaggccccgggccaggtgcaagtgaggagcttcatcccaccttggagtcgtgtgtgggggacggatgtcctggcctcagcagaggccctgtgatcgccaccattgtcaccgtcctgtgcctactgctgctcctggcaggtgtggggatggtgtggggctaccgcaagtgccagcacaagagctctgtgtacaagctgaatgttggccagcggcaggctcggcactaccaccagcagatcgagatggagaaggtctaggcacctttggagtgggttctcccaaagccacttgggaggaaaataactgtgacacatcacacgataattcactagagcatgacgcaggtggactgaggctcatcattttttcctcagccctttgttttataggctgagaagtgtctctggagcacctgggagggcagggaggctttggtgacatcatcactcatgtcaatgtctcctccaccatctgccctggaattgactacactaatcccagacctgtgcttgggccctgtttccagtgtgaggtcaaaaatcgcctcttccttcatcacagtattatctttttttttttgagacagagtctcatgctgttgcccaggctggagtgcagtgtcccgatctgagctcactgcaacctctgcctcccaagttcaagcaattctcctgcctcagcctcccaagtaggtgggattacaggcatgcaccaccatgcccagctaatttttttatatttttagtagagatggagtttcaccatgttggccaggctggtcaagaactcctgacctcaagtgatctgccctccttagcctcccaaagtgctaggattccaggtgtgagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgtcatttattttattttattttcaatatttcatggttaaggatttgccattattttttaaaaacaaagttagctttgtaccagtaagtaccatttcctctcagaagcagtggcctagttgtccttgaccagtctgtgcctaggaatgtcttggaatttttgccaggactaacaaaactcagtccttggtttcctctctcaggattaaccatttctctgaactccagtaagagagaatgacacgggagaaaaaaaaaagaaatgttttcagagggccgaacaccaggttatcaagtatgggcacatacttgatggagaagcagaagaatctgtgaaagaatatgaaatgatctgtgctgatctgttctctagtgtggaaactgggagctctgtggaaacagaatccatcctgtctgttgggtaacccatttcgtagcatctaaatcatcttagggtggctcagcgaggatggtttatggcagtggttctcaaagtgtggtcctcagaccagtagcatcagcgtcacctgggaatttgttggagatgcaaattctctagtcccaccctggactcaggaaacaggaaccctgggagtagggcccagttctgtttttaacaagccctccaggtgattttgatatgcactcaagtttgagagcctgttggtttataataatctcaaatgtgaacttcgaggccagctgaagccctaaaggcacagatgagtatgtggtgtgtgttgtgtggaagtcaggcatggctgtgtgcagctgaggtggcatttgaagctgcctaaatgccacctgcaatagtctcctgtatgttggcacagaaatgaaacatgttatatttttctaatatgaatcaccttcttagaaatagttatcagtggtaaaaagtgatgaatgcaacacatttattttgagacaccatagcagtctaagtgtttttgtgtggtagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgcccc

SEQ ID NO: 202 - DNA, 1895 bp, Homo sapiens
cttcatctctccatctctgcgctgctgccggctgcgccatccagcacccagactccagcaccggccgaggacccccactccggctgcagggaccctgtcccagcgagaccgcaggcatgtcatccgaaaagtcaggactcccagactcagtccctcacacttctccgccgcccttcaatgcccctcagcctccagccgaacccccagccccaccgccacaggcagccccttcctcacaccatcaccaccaccactactaccatcagtctggcaccgccaccctcccgcgcttaggggcagggggcctggcctcttccgcggccaccgctcagcgcggtccctcctcctctgccacgctgccgaggcccccccaccacgcccctcccggccctgctgccggggcacccccacccggctgcgctaccttgccccgcatgccacccgacccttacctgcaggagactcgcttcgagggcccacttcccccgccgccgcccgctgccgccgccccgcccccgccggcgccagcccagactgcccaggcccctggcttcgtggtgcccacgcacgcggggactgtgggcacgctgccgctggggggctacgtagcgcccggataccccctgcagctgcagccttgcactgcttacgtgccggtctacccggtgggcacgccatatgcaggcgggaccccggggggaacaggagtgacctccactctccccccgccgccccagggcccagggctggccctactggagccgaggcgcccgccacacgactacatgcccatcgcggtgctgaccaccatctgttgcttctggcctactggcatcattgccatcttcaaggccgtgcaggtgcgcacggccttggcccgcggagacatggtgtcggccgagatcgcttcacgcgaggcccggaacttctccttcatctccctggccgtgggcatcgcggccatggtgctctgtaccatcctcaccgtagtcatcatcatcgccgcgcagcaccacgagaactactgggatccctaaaaacgcccctggtccggccccactctgcgcccctcgatctcccaggctctttctgcagtcataccgcggacccaatgggcgccctgcacacccgtttctggggccgtcagacttggatacatcgtaaactccgcctccacggaacgtctcgccttgcgagcaagctcggaatccagttcctcaggaacccctccaaaacccacacccccagggacgccgctttccgggatcccggccaaacgccggaccctcagtcgctccaggccccctcaccctcaaagtgtagcgcccccaaccgagcaacctcggtttggtccctaaaaccccgcctcctctataagcaccgccccagctctgacaaaaccccgcctccaggtcggcaggctccgccttcttttcttctccgcggggtgattcagtccagtgattgggtttgtggctccaggcctcgcccacagacggacagacccctccctttcttccggcaaaaggaccgagccctggggtagtaaggcccccacactcctgttttttgcaagtacatttttgtccctcctccacccaggtatctgcctattttcttgctaatcccagaacctttccttttgctttttttaaggacatttgggaagttcctggtgtaggacccttctccctgggataagaaacctgcctgtaaacgctctgtaaatactcccttccacccatcccagcccctgggcagccgggcagaagggaatccaggctatggacctcccaagtccccgctccccgctcccctcggcggccccgccttgttctgatctgtgtgtgagtgtgtgtgaacttctgaaagacaatattaaagagacttagttg

SEQ ID NO: 203 - DNA, 1971 bp, Homo sapiens
gaaggccatggtctccccacggatgtccgggctcctctcccagactgtgatcctagcgctcattttcctcccccagacacggcccgctggcgtcttcgagctgcagatccactctttcgggccgggtccaggccctggggccccgcggtccccctgcagcgcccggctcccctgccgcctcttcttcagagtctgcctgaagcctgggctctcagaggaggccgccgagtccccgtgcgccctgggcgcggcgctgagtgcgcgcggaccggtctacaccgagcagcccggagcgcccgcgcctgatctcccactgcccgacgggctcttgcaggtgcccttccgggacgcctggcctggcaccttctctttcatcatcgaaacctggagagaggagttaggagaccagattggagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgctggtgtgccgagcaggctgcagccctgagcatggcttctgtgaacagcccggtgaatgccgatgcctagagggctggactggacccctctgcacggtccctgtctccaccagcagctgcctcagccccaggggcccgtcctctgctaccaccggatgccttgtccctgggcctgggccctgtgacgggaacccgtgtgccaatggaggcagctgtagtgagacacccaggtcctttgaatgcacctgcccgcgtgggttctacgggctgcggtgtgaggtgagcggggtgacatgtgcagatggaccctgcttcaacggcggcttgtgtgtcgggggtgcagaccctgactctgcctacatctgccactgcccacctggtttccaaggctccaactgtgagaagagggtggaccggtgcagcctgcagccatgccgcaatggcggactctgcctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtggccactcccaggatgctgggtctcgcttgctggctgggaccccggagccgtcagtccacgcactcccggatgcactcaacaacctaaggacgcaggagggttccggggatggtccgagctcgtccgtagattggaatcgccctgaagatgtagaccctcaagggatttatgtcatatctgctccttccatctacgctcgggaggtagcgacgccccttttccccccgctacacactgggcgcgctgggcagaggcagcacctgctttttccctacccttcctcgattctgtccgtgaaatgaattgggtagagtctctggaaggttttaagcccattttcagttctaacttactttcatcctattttgcatccctcttatcgttttgagctacctgccatcttctcttt

SEQ ID NO: 204 - DNA, 1813 bp, Homo sapiens
acatggaatgatcagaatcgtggaggcaaagctctgtccaaaaatgttcattttgttttgttttgttttgttttcttgtttttaacatttccttcatcctggtgaaatatcctggaaattcatagatctgggtttggtgatttcaaaactcaccatgcccagtggccatttcagttactgccgtgacatccctgaggctaccatactctcaaaaccaaatcaatgccagtgatctaacaggattctttcttatttatgagttttgtttagatggatatttttgcagagcataaaaaattaaatgacatttagttatccattgaatgtatcaccctgacttaaaaaaaaatccttaaatcaaaacttttcaaaaaatctgggctatggagtcactccctctgtggagcgagagcccagtcttttctggtactaaggccacagaggcaatttccagtagcatttttatatcttctctaagtttcttttccttttctgtctgtatctgtttttctctgactgcctatatcttactttgtatacccatacataaattattttcccatcttctctcttcccctttttttctgatttgttttctctcttgcaagaaactctgaaataaccttcagaacacaaaaaactggaggttctatacctacagagtcattatcattattgtgattaccattgttactgttgttggtgtttttcctctttttattgtgtagcaatatccatattcacttctgatgaggcaaacctgtttactataaaccaatgtcctccctaaaggagtcagtttcattttcacttctcacatcaccagttgtatcgcaacccatcttacaaccattgccatgttttcaggcttccttgccataaatgttttctgggcaaataatggcaaagcaacaattccagaatgctgtctagatctgctttctcccaccctcagcatttgaccctcctcattcgcctgagcccccagggttaggatttcttggaaaaacttgtatactgtacctgatggaatgcccattcttcctaactacttagcacaagtgcttgctcatcgtaagtgatctgagggccactaattcctgaagactgacaaagagacacgaagagactaccctcttaagatggggatgcatggttcttcatgcagtgctcttggccaccgagatccttcatccatgccattgcatggatgaatacgtttgatgttggcagttaaaatgggatgggagtgtcaccctgcaggaagtaagaaaagaggatggcaggatctctgatcagggagctggtcaaagcagggctggaaagcttctgtgcttaacaaaatgtgcatgctgtccccaagtaaatgctcatccctaggtttagagctgacctgggttttggggagtttgtatttttaaggaattaaatactcatgagttaaaatactcatgattgcaaagaaggtctggattgcctgaaaaacaaattaattctaagaagctaatatgagtttctcatcatcccttagctcttccttttccctccttttgtcctcactcaaccccagaccctgtgtaataggaacattaatttttaaagacccacagatcaatagccacactcttccactctacaccttttattgacaccaagttatcatcccagaactaatgaagcaagtccagatgctagacgtggccccttaatattgagcaatttgattgcaatcctgcttgtttttgtaagttatctcaactttattcttgtgaaattgcaaaggaagatcaataaaaagacttcatatgaatgt

SEQ ID NO: 205 - DNA, 3064 bp, Homo sapiens
atgtactcccaattacttctggaagtttctcaaagtactcctttatatatactgcagagtgtatttttcttcctcctcaactgagatctttccaacttgccaccatgcagctgccaatggtcctagttaagtaaaatgctgccatacctattttagactcagggaaaaatagcacccactcatttttatttttgctcaatataaaaatgaggatacttatgaggatacttaaacttttaggattagctagttttctaaaaatcgaattattcactcctttgtaaagtatgtaataggaatttgctctaataatcaatagattaaggtttaaaatttgaaaccatagtaatgtatgtttaacaccaatattttaagcctttttaaaaaccacaacccacattaagaaatacatttcatactgtgatcaagtacacacgcacacacacactctatacatatatgtctgtccaattaaaagtttcacagaaatttccaaggaggtatgctaaatattatctctttgattctactttatttttaaaaagtggtatcaacccacaaaatggatttcataacccactacgcagtttgataagatgctgttttagaccatgcttttcaccagttttgtggtcctattttgtccttttcatgtctatacaggatgcttctagtgctagttgctagcttttctctgatttccaggatggtaataggttaagaatttctctaaatggttatttcttttctttctgcagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagctacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaa

SEQ ID NO: 206 - DNA, 2530 bp, Homo sapiens
ggaattccctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcatcctgaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacgatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggcttttttttcctaataccaccg

SEQ ID NO: 207 - DNA, 455 bp, Homo sapiens
ttctatttctatttctttttttttcctctttttttttttttcaagccgcaggacgattttctggttcccggggatcaaaaccagcggccaggcggttctatgccgcttggcaccgctttcattttatttcaaatgaagacgttgagcttagtcagaaggggcataaatcaggacaattagcattggcgccaagaagatcctctaataccaatttcgcccgggtttccttcgcgcattcctccactcaagtcagaaatgtcactgcacatagcactgatggcagtgagacgcgacgcacccaaagtccgtttgatgaaatatacatggcccacgacgcttctggattgcggctcccggactccccgcccccaccagcggctcccggccgggaccctgctccgagcgggcagcgagctcctggcaaacttaggggccagtgccaattaaagagtgag

SEQ ID NO: 208 - DNA, 3512 bp, Homo sapiens
gacatggcgagtgtagtgctgccgagcggatcccagtgtgcggcggcagcggcggcggcggcgcctcccgggctccggctccggcttctgctgttgctcttctccgccgcggcactgatccccacaggtgatgggcagaatctgtttacgaaagacgtgacagtgatcgagggagaggttgcgaccatcagttgccaagtcaataagagtgacgactctgtgattcagctactgaatcccaacaggcagaccatttatttcagggacttcaggcctttgaaggacagcaggtttcagttgctgaatttttctagcagtgaactcaaagtatcattgacaaacgtctcaatttctgatgaaggaagatacttttgccagctctataccgatcccccacaggaaagttacaccaccatcacagtcctggtcccaccacgtaatctgatgatcgatatccagagagacactgcggtggaaggtgaggagattgaagtcaactgcactgctatggccagcaagccagccacgactatcaggtggttcaaagggaacacagagctaaaaggcaaatcggaggtggaagagtggtcagacatgtacactgtgaccagtcagctgatgctgaaggtgcacaaggaggacgatggggtcccagtgatctgccaggtggagcaccctgcggtcactggaaacctgcagacccagcggtatctagaagtacagtataagccacaagtgcacattcagatgacttatcctctacaaggcttaacccgggaaggggacgcgcttgagttaacatgtgaagccatcgggaagccccagcctgtgatggtaacttgggtgagagtcgatgatgaaatgcctcaacacgccgtactgtctgggcccaacctgttcatcaataacctaaacaaaacagataatggtacataccgctgtgaagcttcaaacatagtggggaaagctcactcggattatatgctgtatgtatacgatccccccacaactatccctcctcccacaacaaccaccaccaccaccaccaccaccaccaccaccatccttaccatcatcacagattcccgagcaggtgaagaaggctcgatcagggcagtggatcatgccgtgatcggtggcgtcgtggcggtggtggtgttcgccatgctgtgcttgctcatcattctggggcgctattttgccagacataaaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttaggatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgattttttttttttttttcctttgtgcttagttaggaaggcagtaggatgtggcctgcatgtactgtatattacagatatttgtcatgctgggatttccaactcgaatctgtgtgaaactttcattccttcagatttggcttgacaaaggcaggaggtacaaaagaagggctggtattgttctcacactggtctgctgtcgctctcagttctcgataggtcagagcagaggtggaaaaacagcatgtacggattttcagttacttaatcaaaactcaaatgtgagtgtttttatctttttacctttcatacactagccttggcctctttcctcagccttaagaaccatctgccaaaaattactgatcctcgcatgatggcagccatagtgcatagctactaaaatcagtgaccttgaacatatcttagatggggagcctcgggaaaaggtagaggagtcacgttaccatttacatgttttaaagaaagaagtgtggggattttcactgaaacgtctaggaaatctagaagtagtcctgaaggacagaaactaaactcttaccatatgtttggtaagactccagactccagctaacagtccctatggaaagatggcatcaaaaaagatagatctatatatatatataaatatatattctattacattttcagtgagtaattttggattttgcaaggtgcatttttactattgttacattatgtggaaaacttatgctgatttatttaagggggaaaaagtgtcaactctttgttatttgaaaacatgtttatttttcttgtctttattttaacctttgatagaaccattgcaatatgggggccttttgggaacggactggtatgtaaaagaaaatccattatcgagcagcattttatttacccctcccctatccctaggcacttaaccaagacaaaaagccacaatgaacatccctttttcaatgaattttataatctgcagctctattccgagcccttagcacccattccgaccatagtataatcatatcaaagggtgagaatcatttagcatgttgttgaaaggttttttttcagttgttctttttagaaaaaaag

SEQ ID NO: 209 - DNA, 627 bp, Homo sapiens
agtctccggcgagttgttgcctgggctggacgtggttttgtctgctgcgcccgctcttcgcgctctcgtttcattttctgcagcgcgccacgaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaa

SEQ ID NO: 210 - DNA, 358 bp, Homo sapiens
gaatccacaccctcggaccataatccaagttaccttctgctatagccatacatacccattaaaaccacacttccacagagtcagcttgtctgggctcaatgggctctcaaaataatacagggttccattacctctgacccagaggttctctccaagagaaagagctgttgatgttacaattctgcctgtcactgtccctgttatagcagggagtgcgtactggattagtactccccagaaggatgtatggtcagttggattggtggtggatggcagtttgtaccaaaacgtcacttgaacttcacctttgacagctgcagacttccgcgtgctgataaggaattaaagaaagtggaaa

SEQ ID NO: 211 - DNA, 1233 bp, Homo sapiens
  misc_feature (493)..(493): n is a, c, g, or t
ttgagtgtagacacagccagtgccaagctaaaattaaccctcactaaagggaataagcttgcggccgctcattttttttttttttttttcctgagtttggcatctcaggtgccactataggaatagctggcataattattgcctcctcaacttaccaaaacctgtctctggaactgactcacaaaataaaaactactgctcagactcttacagagtgacaccaacaagttgattatctcgtggctgtagtttgaaattgtagaggtcttgctgcagctcaggaaagaatctgccttatgctaggagaaaaatgctgtttctgggttaacagattagggaaagtccaggaccatgttagaggttttacaaaccaggcctgtcaccatcagaaacatgccactgaaagctagttctcttggggtgccacttggttccaattctcatgacatcccactttttggggatccctagcctttgtcttcctttctctctnttgtgagccttgctcactaaatctagtaaccaggttcgtttcctcgtgcccaattcttgggctcgagggccaaattccctatagtgagtcgtattaaattcgtaatcatgtcataactgtttcctggtgtgaaattgttatccgctcacaattccacacaacatatcatgcgggaccataaagtgtaaaccctggggtgcctaaagagttgagctaactcacattaagttgcgttttcgcttaactggccgccttttccaatccaggaaaactttcttggccaggctgcatttaatgaagcgcggaatccccgcgcgtgaaaaaggcggttttgcgtttttgggtggcctcttccgcgttctctcgctaatttaactccctgtgcctctggccgtttcggctgttcgggaactggtccaaggttacactgcaaggtggtagtacggttgtctcgacacaattcgtggtgatcatcgccgcgaggtgaaagttgtctgtaactgtgcgagcatagtggcacatgtgccttgtgaagagtgtctctcgtctcagggtgtttctgatataacggctccctgtcagaggtgtcatcgagttatggtgtgatagtgtgtgatggtgcagggtggccgtcgggctaggtgtgtgctagtggctgtgcgcccatcgagcaatcggttgcagcgtgttccatgggctcacatgtgtcctatgttgcttgtgcttgttgcgtgttcatg

SEQ ID NO: 212 - DNA, 1926 bp, Homo sapiens
ggagatattatgaggctgttgtcattagggcgattgcggtggaatcgctgaatcttgactcggcggtggttggctctccctctcctctctccctctccctctccctctctgtctcgggttctctctctgcgcgcgcgcaccgggccgctctcctacctccctctctatgtggctgcgcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcggacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaagatcaatcaccaccacgaggacaagagggcaatgagcatgaacagacagagtaagaaacaagtcgccgtctccgttccg

SEQ ID NO: 213 - DNA, 2566 bp, Homo sapiens
actgcgcgggggcgggaccggggagctagctgcagactccacgttttgcaaagatcggttttgcctcagagtcaacaaactcttcagattggttccggtgtgtcctatgtttacaagtcagtggaaattaagcacaacacatataaattgaaaagtcaaataaggaaatgaattacctcccttgacggctctaattttacttggctaaagccaatttttaggttggcttgggcagaaaagtgaaaagagaatgctccactttaaccgatgtcatcatctgaaaaagataacacagaaatgtttttctagtatacatgttaaaacggataaacatgcacagcgatttctttcaagaacctttgcacttgcggaattgaggaagtcatggtattcaacccactctcttgttggagacaaaaatattatcctgatgggacctcctggtgctgggaaaacaacagtaggcagaataataggtcagaaactaggttgttgtgtcatagatgtggatgatgatatccttgaaaaaaactggaatatgagtgtgtctgaaaaattacaggatgttggtaatgagcaatttttagaagaggaaggaaaagctgtgttaaacttctctgcatctggaagtgtgatttcccttactgggtccaatccaatgcatgatgctagcatgtggcatctgaagaaaaatggaataattgtatacctggatgtacctctactagatctaatttgtcgtctaaaattaatgaagacagataggattgtaggtcagaattctggaacatctatgaaagacttacttaaatttagaagacagtattataagaagtggtatgatgctcgtgttttctgtgaaagtggggcttccccagaggaggtagctgacaaagtgctgaatgcaattaaaagataccaagatgtggactcggaaacattcatttcaacaagacacgtttggcctgaagactgtgaacagaaggtttcagcaaaattctttagtgaagctgtaattgaggggttggcttctgatggtggcctctttgttcctgcaaaggagtttccaaaattaagctgcggggagtggaaaagcctagtaggagcaacctacgtagaaagagcacagatactgttggaaagatgtatccatcctgcagacatacctgctgccaggttgggagaaatgattgaaactgcttatggggaaaactttgcctgctcaaaaattgctcctgtcaggcacctttcaggcaaccagttcatcctggagttgtttcatggaccaacaggatcatttaaagatttgtctttacagcttatgcctcatatttttgcacactgtatcccaccaagttgcaattatatgatacttgtagctacttcaggagacacagggagtgcagtcttaaatggttttagtcgtctaaataagaatgataagcaaaggatagctgtggttgcattttttcctgagaatggagtaagtgattttcaaaaagcacaaataattggcagtcagagagaaaatggatgggcagtgggtgttgagtcagattttgatttttgccagacagctataaaaagaatttttaatgattctgattttactggctttcttactgtggaatatggaacaatcttaagttcggctaactccataaactggggccgactacttccgcaggtagtttatcatgcttccgcatatcttgatcttgttagtcaaggatttatttcttttggaagcccagtcgatgtctgtattcccacaggaaactttggtaacattttagcagcagtgtatgccaaaatgatgggaatcccgattcgaaaatttatctgtgcctctaatcagaaccatgttttgactgattttataaaaacaggacattatgatctaagggaaagaaaactagcacaaaccttttcaccgtcaatagatattctcaaatcttcaaacctagaacgacatttacacttgatggctaataaagatggacagctaatgacagaattatttaatcgattagaaagtcagcatcatttccagatagaaaaggctctagttgagaaacttcagcaggattttgtagctgactggtgctctgagggagagtgcctagcagctattaactccacctataatacttcagggtatattttggatccacacactgctgttgcaaaagtggttgcagatagggtgcaagacaaaacttgccctgtgattatctcatctacagcccattactcaaagtttgcacctgctatcatgcaggctttaaagattaaagaaatcaatgagacttcatcaagtcagctctatttgctgggttcatacaatgcattacctccactgcgtgaggctttattagagagaacaaaacagcaagagaagatggagtaccaggtctgtgcagctgatatgaatgtcttgaagagtcatgtggaacaacttgtccaaaatcaattcatatgaaagctttcagagtaaatttttttttctagctataagcatgcaataataaatctcaaacactgatttggaaaaaaaaaaaaaaaa

SEQ ID NO: 214 - DNA, 2393 bp, Homo sapiens
ggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagagtgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcatgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactcttttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcctataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacaaaaaaaaaaaa

SEQ ID NO: 215 - DNA, 575 bp, Homo sapiens
actcttctggtccccacagactcagagagaacccaccatggtgctgtctcctgccgacaagaccaacgtcaaggccgcctggggtaaggtcggcgcgcacgctggcgagtatggtgcggaggccctggagaggatgttcctgtccttccccaccaccaagacctacttcccgcacttcgacctgagccacggctctgcccaggttaagggccacggcaagaaggtggccgacgcgctgaccaacgccgtggcgcacgtggacgacatgcccaacgcgctgtccgccctgagcgacctgcacgcgcacaagcttcgggtggacccggtcaacttcaagctcctaagccactgcctgctggtgaccctggccgcccacctccccgccgagttcacccctgcggtgcacgcctccctggacaagttcctggcttctgtgagcaccgtgctgacctccaaataccgttaagctggagcctcggtagccgttcctcctgcccgctgggcctcccaacgggccctcctcccctccttgcaccggcccttcctggtctttgaataaagtctgagtgggcggc

SEQ ID NO: 216 - DNA, 3825 bp, Homo sapiens
agatgccgcgggggccgctcgcagccgccgctgacttgtgaatgggaccgggactggggccgggactgacaccgcagcgcttgccctgcgccagggactggcggctcggaggttgcgtccaccctcaagggccccagaaatcactgtgttttcagctcagcggccctgtgacattccttcgtgttgtcatttgttgagtgaccaatcagatgggtggagtgtgttacagaaattggcagcaagtatccaatgggtgaagaagaagctaactggggacgtgggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagagcgtataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccaaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagccaaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctgggttgcccaagcttaatggaacccccctctcccagggaagacatgagattgctttatctgggcttccagctgatgctattttcctatgttaaagtaaacagaagattttgtcttctgggggtctttataaaacttcctttcctctatgtggtggctacagagagtccaaccacacttacgtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaaacaggtatttttttaaatcaaggaaaggctcatttaaaacaggcaaagttttacagagaggatacatttaataaaactgcgaggacatcaaagtggtaaatactgtgaaataccttttctcacaaaaaggcaaatattgaagttgtttatcaacttcgctagaaaaaaaaaacacttggcatacaaaatatttaagtgaaggagaagtctaacgctgaactgacaatgaagggaaattgtttatgtgttatgaacatccaagtctttcttcttttttaagttgtcaaagaagcttccacaaaattagaaaggacaacagttctgagctgtaatttcgccttaaactctggacactctatatgtagtgcatttttaaacttgaaatatataatattcagccagcttaaacccatacaatgtatgtacaatacaatgtacaattatgtctcttgagcatcaatcttgttactgctgattcttgtaaatctttttgcttctactttcatcttaaactaatacgtgccagatataactgtcttgtttcagtgagagacgccctatttctatgtcatttttaatgtatctatttgtacaattttaaagttcttattttagtatacgtataaatatcagtattctgacatgtaagaaaatgttacggcatcacacttatattttatgaacattgtactgttgctttaatatgagcttcaatataagaagcaatctttgaaataaaaaaagattttttttt

SEQ ID NO: 217 - DNA, 2251 bp, Homo sapiens
ctgggatcaggcaaccctctcacctcagcctcccaagtagctgggactacaggtgcacgctaccatgcctggctaatttttttgtacttttagtaaagacggggttttgtcatgttgctcgggctagcctcaaactcctgggctcaagcgatcctccctcctcggcctcccaaagtgctgggattacaggcttgagccaccgcacctggccttccccatttttctcttaatccatatctcagacaggaatctgtatctctcactctacagatcattctgtaggcactatgctaaactgacaccagtttcaaatttagtccttaattgatcttggcctttaggtgagcaaagttacagtggtaaattacgctccttcgcttacaaaatctcttgcttggtatttattccccaggggttacatagaatagagtggaggcagtagacatggagaaatcctatcttttaagaaagaaaaaaatgggcatttttctcatggggaaggatttttatttttcaaataggtgtttgaactgtaatgatttcatgacatctgcctaacggttttgtttctttgtcttacagaaacaaacagtcgttgctgtcaaaaaagagatcatgtattaccaacaggccttgatgaggtccacagtgaagtcttctgtgtccctgggagggattgtgaaatacagtgagcagttctcatccaacgatgccatcatgtcaggctgcctccccagcaacccctggatcaccgatgacacccagttctgggacttaaatgccaaattggtggaaatcccaaccaagatgcgagtggaacgatgggccttcaacttcagcgaattgatccgagaccccaaaggtcgacagagcttccagtacttcctcaagaaagaattcagtggagagaatctgggattctgggaagcctgcgaggatctgaagtatggagatcagtccaaagtcaaggagaaagcagaggagatttacaagctgttcctggccccgggggcgaggcgctggatcaacatagatggcaaaaccatggacatcaccgtgaaggggctgaagcacccccaccgctatgtgctggacgccgcacaaacccacatttacatgctcatgaagaaggattcttatgctcgctatttaaaatctccgatctataaggacatgcaggccaaagctattgaccctcaggaaacaaccaagaaaagctccaccctcccttttatgcggcgtcacctgcgctccagcccaagccctgtcatcctgagacagctggaagaggaagccaaggcccgagaagcagccaacactgtggacatcacccagccgggccagcacatggctcccagcccccatctgaccgtgtacaccgggacctgcatgcccccgtctccttctagccccttctcctcctcctgccgctcccccaggaagcctttcgcctcacccagccgcttcatccggcgaccaaccatctgcccctcaccgatcctagtggtcttggatagctcatcgggcttggagcagaaaggggagtgcagctggtctggtgccaaccctgggccctctgtcaccgacagcagcgaggcctcccgcgacacctcctggactcgcagccggcccagggcccctctcaaggcccgcatggctctgtccttcagcaggtttctgagacgaggctgtctggcttcacctgtctttgccagggtgtcacccaagtgccctgctgtgtcccacgggagggtgcagcccctgggggacgtgggccagcagctgccacgattgaaatccaagagagtagcaaactttttccagatcaaaatggatgtgcccacggggagcgggacctgcttgatggactcggaggatgctggaacaggagagtcgggtgaccgggccacagaaaaggaggtcatctgcccctgggagagcctgtaaggaaagaggcaggctgagttgggggctctggaccaggaagatgttctgacagatgccatggtatgggccacaggacacacttgctcgagaaccaaagtgcatttgggtgacatttgaagattggggagacaagatggggtagattgtggcaaagaatgctctggctggttaccaggggccaactccttctcctcttcctgaccctccctcccctgggcagaagaaacgcatgtggaccagaagactttccctgctgccttaaaaccaataaaaggttaaattgaaaaaaaaaaaaaaaaaaaaa

SEQ ID NO: 218 - DNA, 552 bp, Homo sapiens
cttttgaaaacacgtgtatggtcatgttatttcctcttaaaattttccaaaggcttcttatcctttcaggataaaatgcagactccgaagcctgacgttgaaggttccccataatctgacttctcctgttgtacgccacgcccatgtgacctcacgtttctcctttctctctctttcgcttccccctcttgcctttttcctttctcccccctccccttttctccctcagttaagatgctacttcttccatgacaaatgatgctataggaggaagtcatttctttctctgcgtttgctttgaacctctcctattgctttgtcttttttttcttaccatggattaaaatatctgtgtacatgttttctgttgaattaggagcatctaattcagtgttagacacggttctacgtgttagcagtatcatctggaataagacagcctctgttcttggggagggagggtccttgtctttttcattcttggaactttttagaggtgatttgacaaataaataaatgctctattcaaaagttactaaaaaaaaaaaaaaa

SEQ ID NO: 219 - DNA, 3699 bp, Homo sapiens
gctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaagctcttcttcaagtgacaatttcacttagcaaagtagagcttagtgttggagaatctaaattcttcacatgtacagcgattggtgaacctgaaagtatagattggtataatcctcaaggagagaagataatttcaacacagagggtagtagtgcaaaaggaaggtgttaggtcacggttaaccatctacaatgcaaatatagaagatgcagggatatatcgttgtcaagcaacagatgccaaaggacaaacacaagaagctacagtagttttggaaatttaccaaaaactcactttcagagaagtggtatctccacaagaattcaaacaaggagaagatgcagaagtggtttgccgagttagcagttcacctgcacctgctgtcagctggttgtatcataatgaggaagtcaccactatttccgacaatcggttcgctatgttagcaaacaataacctgcagattctcaacatcaataaaagtgatgaaggtatatacagatgtgaaggaagagtggaggccaggggagaaattgacttccgtgatatcattgttattgttaatgtgccgccagcaatctcaatgcctcagaaatcttttaatgccacagcagagagaggagaagaaatgacattttcctgcagggcctcaggctctccagaacccgccatctcctggttcaggaatggcaagctcattgaagaaaatgagaagtacatattgaaagggagcaatacagaactcactgtcaggaacataatcaatagtgatggtggtccttatgtctgcagggccacaaataaggcaggagaagatgaaaagcaagctttcctccaagtctttgtacagcctcacataatacagcttaaaaatgaaactacatatgagaatggtcaagtcacactcgtatgtgatgcggaaggggagcctattccagaaatcacttggaaaagagctgtggatggcttcacgttcactgaaggcgataagagcctggacggccgtatcgaagtcaaagggcagcatggaagctcatcactgcatattaaagatgtgaagttgtcagattcagggagatatgactgtgaagctgcaagcagaattggagggcatcaaaagagcatgtaccttgatattgaatatgcccccaagtttatatcaaaccaaacaatttattactcttgggaaggaaatcctatcaatataagttgtgatgtgaaatcgaatccaccagcatcaattcactggagaagagataaattagtcttacctgctaaaaacacgaccaatttaaagacttatagtacaggaagaaagatgatattagagattgcacctacatctgacaatgactttggacgctataattgcacagccactaatcatataggaacaagatttcaagaatatattcttgctttggctgacgtgccatccagtccctatggagtgaagatcatagagctgtcgcagaccacggccaaggtttccttcaacaaaccggactcccatggaggtgtacctattcatcactatcaggtggatgtcaaagaagtagcgtcagaaatctggaaaattgtacgctcccatggagttcaaacaatggttgttttgaacaacctggaaccaaatacaacttatgaaatcagggttgcagctgtaaatggaaagggacaaggagactacagtaaaatagaaatcttccaaacattaccagttcgtgaaccaagtcctccatccatacatggacagccaagcagtggaaagagctttaaactcagcatcaccaaacaggacgatggaggggcccctattttggaatacattgtgaaatatagaagtaaagataaggaagaccaatggctagagaaaaaagtgcaaggaaataaagaccacatcattttggagcatctccagtggaccatggggtatgaagttcagattacagctgccaatagattgggatattctgaaccgacagtttatgaattcagcatgccaccaaagcccaacattattaaagacacgctgtttaatggtcttgggcttggagcagtaattggcctgggagttgctgcactgctgctaattcttgtggtaacagacgtcagctgcttctttattcggcaatgtgggttgctgatgtgcatcactaggagaatgtgtggaaagaaaagtggctccagtggcaaaagtaaagaactcgaagaaggaaaagctgcatacctgaaagatggatcaaaagaaccaatagtggagatgagaacagaggatgaaagagttactaatcacgaagatgggagcccagtaaatgagccaaatgaaaccacaccactgacagaacctgaaaaattgcctttaaaggaagaagatgggaaagaagctctaaatccagaaactatagaaattaaagtttctaacgacatcattcaatcaaaagaagacgacagcaaagcataacaacaatattacaggggcttgaacaacactacgaagagtatttggattgcgtgaccctatgaccaaaactattccattgaccttaatttcttgggaaacttctagcttggaatagcttgtacacatatacatatgatcaaatactcctgcccatgatccattcccttttgttattgttgttgttgttgctgttgttgttaattttgttaagaatttcaatatcaagactgactggcaccaacactttggtattcaatttgattctatgactgaagtactggaatttattatgtggctaaagtgctctatttattaagaactatatttaataccaccaacaaatataggggttaaggaaaaaaaacgtgagctacatgtgtaagaaggccctgcatgtgtatgagtcctattctgggcaaatagattcttaaagtggctttcaacttcaagatgaaggagcttaataatggttactcattttatcaggggaatttcagggaacgtaggcgtcaaagagccagttatctttagcagatattaaaaattgaaaactttggagaactcatttcaagttatgattcagtgcattttcaacattgatttttgatagactgaagtgccagatcaaaattgttacccatttgaaagaatattagttgtatataaaattagattagaaagactttctaaatctctatctctttatatatgtcctattcattcacaatggattatacaaaaaaaagtgtattgcaagtgaaataatattgatttctgccctcagcttcaaataaagtaaattgaaatgggaacaatatcaatatggtgtcttgatatatttataaatatgtgattatcatttatttttaaaataatttatcaaaaaacaagtctttagtgttcaaatacttcaaatcatatcctcagatatatttt

SEQ ID NO: 220 - DNA, 1619 bp, Homo sapiens
ccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttc

SEQ ID NO: 221 - DNA, 1574 bp, Homo sapiens
atctgtattaggatgtcatcatatctgtattaggatgtattaggattctgttttggctgactacaattttttttttttttttgagacggagttttgctctttgttgcccaggctgcagtgcaatgacgcgatctcggctcacggcaacctccgcctcccaggttcaagtgattctcctgcctcagcctcccaggtagctgggattacaggcatgcgccactatgcctggctatttttgtatttttagtggaggcagggtatctccatgttggtcaggccggtctcgaactcccgacctcaggtgatctgcccacctcagcctcccaaagtgctgggaatacaggcgtgagccaccgcgcctggccggctgactacaaattttttaagtgaccatttaaaaagtgaaattttcatcttgtttggcatcaatcaatagttcttttgttgactccagctacctattacagctgctttttggaagaaaatcggttataaatagtttaaattaagctaagttaaatgagtacaactgcttctcttgagttctgctcggtaacaataactatcttagaaaggcttaagaaaaatattgtaaagaaccttcagtataaaaagcgtagatgaactttgtgaatgtatgccattgattgaataccttttgatcttactgtgcatactaactttcttgatgtaaatatttagtgcgatataaatatttagtgcgtgatttccatagcagatgacaagtttatattgattataacatggtctcggttgatatttttctgacaagtaagtttagatcatgtttggattttgtttcctattacctagagccaacacagatctatagatttctttgaactcggaatctcatagcaccaatatttttgcacagaactcttacttacatgtctcatcgaaactccagaacaaacatcaaaaggaaaacatttaaagttgatgatatgttatcaaaagtagagaaaatgaaaggagagcaagaatctcatagcttgtcagctcatttgcagcttacatttttggtttcttccacaaaaatgataagccatcaccaaactcagaaaatgaacaaaattctgttaccctggaagtcctgcttgtgaaagtttgccacaaaaaaagaaaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattgatgtcagtgaagagcttccagcaagaagaaaatgaaatcgtgaggatggggaaaagacatttgttgcacaaatgacagtatttgataaaaacaggtaatgttgatgaacaagcgaggctcccacaatgttctggaaatgttttcattctgaagcagaatataattatttatattgattaaaaaaaaaaaaaaa

SEQ ID NO: 222 - DNA, 1545 bp, Homo sapiens
ggcgcccggaggagcaagaggaggaggaggaggagaggtcggagccgtctccaggagcccttagagaccgagtcccggcggcgacggcggggcagcgcaccggcaggcggattcattccacttaaaacctgaaaacattggaccacacaaagtcttactgatttcaggtaaaaacaataattgaagatgtccagcaaaacagcaagcaccaacaatatagcccaggcaaggagaactgtgcagcagttaagattagaagcctccattgaaggaataaaggtttcgaaggcatcagcggacctcatgtcctactgtgaggaacatgccaggagtgaccctttgctgataggaataccaacttcagaaaaccctttcaaggataaaaaaacttgcatcatcttatagtggaatagagaaacagctcctcgcctcttcccaacaacgcaaattatgagcagctccttgaagagatttaccttcagcttatttggtaaccactgctaataactaaaatgttctcagcttggaataatggactctgaagtctctattttccaagttgtcctttctcttaaaataccctttactgatttaatacagaataacaatcttattttccacttggtaactatggctttatgttgggttactgtttaaggaaagttgatctgggcctttttaaaaacataattatatactttagaaatacaagggattccgatatgtcaggacctaaatggcctaagcacctgtcaaattaaaattccaaaattcattgaaatcctaaagccttgatattatattctttataaggcgtgtgccagcctgtatagtatataagagagaggggtgtttgtgtgtatatatatatgcctttgtgtatacacttatcaaagctattttcttatgaaaacgtccctctctccataccatcagtttctcagttccagaagttatacctttattttgagctgtgtataggtagaataaaaaattcctttcatatcgttattgtacaaaaagtaaagagtatcctaaagattgtattcattgtaatcaagtaatgcaatcatctctcctctcttgaaatcttgctggacctcttaggctacaataaactgtaccaaactaaactgacagtccttcgataatatgaaacattaatttacaaggacccgttagggcttcaatgatgctgagtctggaaaaggggaggagacccttgggaggactccaggcagctgtgctcccagggctcatgttctctactggattagggataggcacctctgaaatctccaccctgatgattggaatgaaacggagtgaacatgagcccagctgagagaggagcaggaatgtgtgaaaaacagctgctttccttgtcccagctttgtgattgagccctctgtcttgctctctctgccttccctgtgtctttcttctcttaccagagcatctgtttgcagaggtaacattaccttccccagccacaggtatgtggaatacggtgagaaaaaaaaaaaaaaaaaaaaaaaaaaaaaa

SEQ ID NO: 223 - DNA, 2269 bp, Homo sapiens
agtataaacaaggaacccgactggttagacagattttgtttttcttcttcccgcgcgctttagctccctgtcctttggtcgcatttgtgggcgcgcggcacgcagccgggaggccgaggactcggagttcacctgcaggaaagtatgcctcagactcctcccttttcagcaatgtttgacagcagtggttacaatcgaaacctctatcagtctgcagaggacagctgtggagggttgtattaccatgacaacaacctcctctctggatccctggaagcactcatccagcacttagtacctaatgtggattactatccagatagaacatacatatttaccttcctactcagttctcggttatttatgcatccgtatgagctaatggccaaagtttgccacttatgtgttgagcaccagagactaagtgatcctgatagtgataagaaccagatgagaaaaattgcacccaaaatccttcaactcctcacggaatggacggaaacatttccctatgattttcgggatgaaagaatgatgagaaacttaaaagatctggctcaccgaatagccagtggcgaagagcagacatacagaaagaatgtccagcaaatgatgcagtgtctgatccgcaagcttgctgcgctcagccagtacgaagaagtcctggcaaaaatcagctccacatccacagatcggctcacagttctcaagaccaagccacagtctatacaaagggatatcattactgtctgcaacgacccttacacgttggcccagcagctgactcatatagagctggagaggctcaattatattgggccagaagaatttgttcaggcgttcgtgcagaaggaccctttggataatgacaagagttgctacagtgaacggaagaaaacacgaaacttagaagcttacgtggaatggtttaatcgcctcagctacttggttgctacagaaatctgtatgcctgttaagaaaaaacaccgagcaagaatgattgagtatttcattgacgtagctcgggagtgttttaacattggcaacttcaactccttgatggcgataatctctggtatgaatatgagcccagtctctcgactaaaaaaaacttgggccaaagtgaagactgcaaaatttgacattcttgagcatcagatggacccttcaagcaatttctataattatcgaacagctcttcgtggggcagcacaaaggtctttaactgctcatagtagtagagaaaagattgtgataccattcttcagtctcttaatcaaagatatttatttcctcaatgagggttgtgccaaccgccttcccaatggccatgtcaattttgagaaattttgggaactggccaaacaagtgagtgaatttatgacatggaaacaagtggagtgtccatttgagagggaccggaagatcttgcagtatctgctcacagtaccagtcttcagtgaagatgctctctacttggcttcttatgagagtgaaggacctgaaaatcatatagagaaagacagatggaagtctttaaggtcgagcctcttaggcagagtttaacacatgggagctgcctgcctgctgctgctgctgcttcctgcagatcatggaggggctggcctttgttttctggcatctcgtaccacgaacgctcatgaagaccctgcagtcattggagcacccgggtcagcaaagcacacaagctcactcaagaccagatggagaacttatttcctgcagctgacagatagactcagattttgtgagactgaaatgttcactgaagacacttgagaaagaatcctctaaaaatcccggctctgcacattattcatctcctggaatttccatgtgaatcacagctctgcacctggatggagttttcttttgtgtgtgtgtgttttttttaatttggttgaacatttgctgctaatgggacttgcccagctgagtgctggctctgaggaagcccacgtttcttttgttaacttaaatgaagaaaggagtggagggaggggatctaaaacccccccgtttagatcccaaaccttagctcaaccagtattgccagagaggggtaagactggttggaagctgactgcagactttgtttccccttagtatgtgctgtgttgtaaatttttctcctccctcctcctacaaggttttgagttggctgctggttagcaaactcctttttacccatataagttatttaatataataatgaagctcaacactgtggtaggaaaatagccactag

SEQ ID NO: 224 - DNA, 4785 bp, Homo sapiens
agtgacctcatgccaaatggaaatgggttgagaaatcttggttcagtgcttagtgaacaatagcctgcattaaaaagtgcatgcataattttgcacaatttagattcaattgacagtctattcaaagaagtctcaggattaaatgagcatggagaccaaattgccctcctaccccagaaaaggggtggtcccttctagtcacactaacacttcattggcccaacagtgtgacaaatcttgcaatgaaccatgcagtagcctgcatctgtaggttaatagcaatcttttgtctccattgctttctcttcatagcccttttactgaattccatcacagaaagttttacaattaaaaaaaatgtcctgacaaccatttttgtaaatggaccttaccatctaattgtcccttattcaacgtgggtgacattaacaaaatgtgaacttcttgtgagggagccagctgtctaaatctgtcaaatcgtgcagttttattacacattctccaattcttcctagtttccctgaaaacaataaggatactgctatacattcagtaaaatctaaaaaatcaagcattacttcttacatctttaaactttccatctcctccccaaaataaaaggtgttctattgccattagttctactgttttaaaatatctatattaagttgaccaggcccagattttttatacagctttttcccaagtgaaagattttcaagtgacttagaaaaacatatgtgccccaggtgtcattgccttttcttttgtgagtcattagaatgaaaggccaagttcttctcaagagaagatagcaagatccacggatattaagccaagcaaagaaagtaaaatcattgcagtcatttctttctgttcttaggagaaaagtagatagcactggctaattgatggcaacatattttaaattaagtggtcaattcaaaaattctctttgaccttttctttcaagtagatttttttaaatgcatgactggagaattatcttcaatgattcatgatgagaggcaggtaggaattggttaagaagtatgagcaggaaaaaattattgtttaatcacatgaaaggcaacatctgttcagttcataaagcacacaatctcgaatggaagaaaaaaaggtccttcgtaagaatactgatgcataagataaagacgaaataatgaaaaagaaaaatgtatattattattcccttgtccattctcaagtttaagctgcggttgtcagttgaatgtgaaatgatgttatagttgttttaaatggttggaaataacctttctactactgtttctgccacactgttgtcctggttcatagaaccttgttttcttgacagttatttaaggtaataaaaggaacacaatttggcagatctttaagtgaaagagagaaaaaatttaagaaattgagtgatggctaaaagtaagtgcttccatccataacttttcttcttggatttttttcaatgtaattattgtaaaattttttttttattttatcatgaagaatactcggaaggtttctcagattaatgagtatctcataaagagtagagaaaccaacacatacaatatatacacacaacctaaatagaaaactattttctttgtcatttgcatgccccagagaagttacttcttccctatttatttctttgaaaataattacaaaatagtatactaacaattttaatccatttgctgtttttttttttttttttggtttctttttttttttttttgagacggagccttgctatgttgcccaggctgcagagcagcacaatctcagctcactacaacctccgcctcccgggttcaagcaattctcctgcctcagcctcccaagtagctgggattacaggtgcccgccaccacacccggctaatttttttgtgtttttagtagagacagggtttcaccatgttggccaggctgatttcaaactccagacttcaagtgatccagccccccaggcctcccaaagtgctaggattacaggcgtgagccaacatgcccggcttccatttgcttttgatattgtttttatctctgagttacaaactatacaagcttaccaggtataaggttagatgctacatctaggagcattcaagatatacattaatttaaacttttattagtctaactttctgttaagtctcttagctttgaaacataaaagagaaatcaagcccaaatttttagaggaaggctaaggtatactattggcagttgtagttttaattgtaattgactgattaaccaagtaatttataaaatgttacctatactgtcagtgttcacctcctctccctccctccttctctctctctctccccctctcgctctctcggctaatatatatgtgtatgtgtatatatatgtatgtatatatatacacacacacacacacatacatacatacatatattctttttccttttaaccacttccctctcctacattttctattggttttgcctaaatagacatgttctcaatacacccatgttgaaggtatcctgggctagattgctgttgattttgctggttatgatcttttctttgtttttctgaaaaatagcctctcttggttccacattttctcaaattctatataacaaataatagtggatagtaaacaaatgacatactaggctgatctattacaatcattgaaagaaataaggaagagcagaaatcactaacagtccagaggctccaattcagctgctctagcatagatacaggaaaggtttgttcacttatgagattaggacttttcttaaattcctcattaaatatgaacctaaggcatacccatcatttaccttgattcccatataatttgtgtaagtcatatataagtccattgacaaaataaaaaaataaataattggattccttgtatcaacagaaagccttgtgcttaaaacctgttattcttctttgagccagactaaacagtaacatttacaaaatggtatcagctcaacattaaatctaaggttacttctcacatacatcataaagtcagccatcatctttcatttaggatttcttggggttttctttttgcatatatagattatgtattacttaaatccaaaatacatgtgtgtatatatatacatatatatgtaacttaatataaatgtttgatgagttatctcaattgactataatcttctaagtcaaaaagaaaacatttaagtacataatataaaaagaactgaacattaacagtaatgggaaattcataatggctaaatatgaaataagctttgtctttgcagttacaaactaattcttgtacattttccttttcactaaaaaaataactaattgatagtttccattcacatgaacaagttataatcaggtttgggatagtatgcccaaaacctatgtttctttactttatattcttaaaatctgagacatgatttttctggaacaaattaagatttcatgtacaatagagtccctttcctaatactgttatgaagaaaccaagttgactaccttatgagagatcagatatttcccttatctcattatattcacagcatatgtttggacatgcgtttcaccaagaaccatgtagtaataagataaatggtaactgaggtactatggaatttttagaacttgattccccaggacatgctacagtaaactaaactatttattcaaaagtaacccaactaattaaagtgaaaaaaaattgttgaatcacaatgaacaaacataaaacaatacttaaatgagaattctgtgtcttttttggttttatctgtgatttattttgtccagtattaaggaatggttatctttatcattcttctaacatgttttggtttctctaatggttcattttcctttagcttgtgaaaattagggcagtttgtccagagccttactcgcaggagacaccagacccaacccatgcttagatttctgttaataaaagggagaagggtatttgaataggtagtaaaggcaggtacaagtttaagggagcagggctatcatatgtactaggtgagatttctataaatgtctgaaaagttacatgcatagtcattggctcaggtaatttctctgaatttgaacttatttgatttatttaaccaagttattataatatgcagttctctttaatcaatcttctattattcaatcatctatccatttattaattcaacaaatatttattaaagtgcctaccatgattatgtgctgtagaaaagacaaggacatttactaggggggattgtgggcccaatcggcatcataagcatgtctgaagcaaaagacaataatcacatccaacggcaccagttcagctcaactttagaattcagcagtaacagtacagatggcctaaagtacatctgtgtgtatctgtacgtgtgcacacacccatgtatatatatttatctatctgtacaaacactacatatgtatacacactatctatgtaaaatataatatatgtataatgcatataaattctaacaagtgtatttgtgttatctttaaaatagaacaattgtatcttgaagtggtaaatgcagagaattggttttattgttgatctgtggatttaatgatttctaggtgaaaaggacgtttaagtgtacaatttcttttcttaatttaatatatttatgtaaatgcatgcctgaaatttggttagattggctgtgttttgtgtcttttaacatgatcaaatgattaaactttatcttatgacttg

SEQ ID NO: 225 - DNA, 4493 bp, Homo sapiens
ggagcgccccgagcggcgcagatagggacgttggggctgtgccccgcggcgcggcgcctgccactgcgcaggcgcctcaggaagagctcggcatcgcccctcttcctccaggtcccccttccccgcaacttcccacgagtgccaggtgccgcgagcgccgagttccgcgcattggaaagaagcgaccgcggcggctggaaccctgattgctgtccttcaacgtgttcattatgaagttattagtaatacttttgttttctggacttataactggttttagaagtgactcttcctctagtttgccacctaagttactactagtatcctttgatggcttcagagctgattatctgaagaactatgaatttcctcatctccagaattttatcaaagaaggtgttttggtagagcatgttaaaaatgtttttatcacaaaaacatttccaaaccactacagtattgtgacaggcttgtatgaagaaagccatggcattgtggctaattccatgtatgatgcagtcacaaagaaacacttttctgactctaatgacaaggatcctttttggtggaatgaggcagtacctatttgggtgaccaatcagcttcaggaaaacagatcaagtgctgctgctatgtggcctggtactgatgtacccattcacgataccatctcttcctattttatgaattacaactcctcagtgtcatttgaggaaagactaaataatattactatgtggctaaacaattcgaacccaccagtcacctttgcaacactatattgggaagaaccagatgcaagtggccacaaatacggacctgaagataaagaaaacatgagcagagtgttgaaaaaaatagatgatcttatcggtgacttagtccaaagactcaagatgttagggctatgggaaaatcttaatgtgatcattacaagtgatcatgggatgacccagtgttctcaggacagactgataaacctggattcctgcatcgatcattcatactacactcttatagatttgagcccagttgctgcaatacttcccaaaataaatagaacagaggtttataacaaactgaaaaactgtagccctcatatgaatgtttatctcaaagaagacattcctaacagattttattaccaacataatgatcgaattcagcccattattttggttgccgatgaaggctggacaattgtgctaaatgaatcatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgcctcataataatcatgcagaatagactttctgtacctcgtccattttctcgacttcagctacaagaagatgatgatgatcctttaattgggtgacatgtgctagggcttatacaaagtgtctttgattaatcacaaaactaagaatacatccaaagaatagtgttgtaactatgaaaaagaatactttgaaagacaaagaacttagactaagcatgttaaaattattactttgttttccttgtgttttgtttcggtgcatttgctaataagataacgctgaccatagtaaaattgttagtaaatcattaggtaacatcttgtggtaggaaatcattaggtaacatcaatcctaactagaaatactaaaaatggcttttgagaaaaatacttcctctgcttgtattttgcgatgaagatgtgatacatctttaaatgaaaatataccaaaatttagtaggcatgtttttctaataaatttatatatttgtaaagaaaacaacagaaatctttatgcaatttgtgaattttgtatattagggaggaaaagcttcctatatttttatatttacctttaattagtttgtatctcaagtaccctcttgaggtaggaaatgctctgtgatggtaaataaaattggagcagacagaaaagatatagcaaatgaagaaatattttaaggaaacctatttgaaaaaaaaagcaaagaccatttgataaaagcctgagttgtcaccattatgtcttaagctgttagtcttaaagattattgttaaaaaattcagaagaaaagagagacaagtgctcttctctctatctatgcttaatgcctttatgtaagttacttagttgtttgcgtgtgcctgtgcaagtgtgtttgtgtgtggttgtgtggacattatgtgatttactatataaggaggtcagagatggactgtggccaggcttccacattcctgaagcacacagatctcaggaaaggttatttttgcacttcatatttgtttactttctcctaactcacaagttaaaatcataacttaatttcattaacttttatcatttaactctctcatgtttgttgtaacctgaggtatccaaatgctacagaaaaatttatgacccaaatacaaatctcaatttgactgggacagaatgaggaatggagatttttgtatttatctttgggactttatgccttactttttaggctatagaatagttaagaaattttaaacaaaatttagtatcttttggtctttcacaccattcatatgttaagtggcagaatagccttagtgctacctccacttttttctccagtatttgcatcacagaaataatccctctgtttaacatgtttgttcagagccaagggtttattgtgaagaactgtcatcctgcctttgctagctggtaccttctagtaatcaaaattaatatgaagaaactaggttgtgacagactagattatatttagtaggggaaaaattgggctcaagaaccattcatcagtacgtgagacaagcagttaatagtatgatctttaaagttttgacaatataaaataaacttggtaactgttttacaaatataaaagtataataaatatgcagcccagttaaatattgattatctgtgatggtaaagaacaacagtggtgccagtcatcaaacatacagtgcgtcctattgagtcactgctaatttcttgagcctggtatttgctgcctattgtatttgtggttgttgagaggcattttcaaaccctgtataaataatccatgctgttggtcataagttaactgtattaagaacagtaaaataaataaaaaccaatagtactaattttgctttaaaaaaatttctaatttttttcacataaaacaattatcctaaaggttaatagttgatcgaaacagaataatagaaaaattctactttaatttccattaaaaagcaaatagcattgacacatttaaagcttttcatttaaagtagtggatgtttttgaagtatctaaaatagtagcagaatattttatacttggtccttgcaatggtgtgagttttaatgattgcattatcgtgattggtggttatgagtttcagaaatctatacttggcatccaactcatgagtggattttatataggatggaacaggaaggtatgtcctgtcagtatcttaaccctttcaacaagacatttacctatttgtctttccttacgttctcaaaatattaactcgaattgtaaattaagcaaaaatttaaaaagtatatgttgatgggacaagaagaatagtatttatttaataaaacatatattatattgaactatgtgttaattcatttgtatcttttaaaaaattatcactgttaaagccattgactcctttagtacactgagaaaaatcttatagtaaaactagcctttcacattaaggttttggtgtgtattttgttaaataactaacatgctgctctattttctgggtgtagaaagtatttggctctaggaaacatttacttgtttgtgaaaacaataccccaaggtaataggaaaagtttgagttaagtgtttttaattcagtcagtgaattcagaataagtacattcatgtataacatagggacagttctgctgctgttatttatatgcaattcttctggtaaatagcaatagaataaaacatatttcaatgtttgtgtataggttttatattattattccactaggaatggcataagaatttatagataaattcttgtaacattaaaggattaaaatgtttttacattgtttttgggtgtctccttcttgtgcccatatctgataagctttatggattattgcatttaattccttttatttggagggttttacttccttgttaacatataaagttataaatgaaggacaaggaggagatggaaaatgtgtatttattgttaattcttaaaatagtgtgtaaataaaataacatcagtgtgcttt

SEQ ID NO: 226 - DNA, 3973 bp, Homo sapiens
cggacggggccgccccgatgggacgccgcgctccggcccctgcgcgccgctgagccgagcgccccccgctgccgagacccccgccgccaccgccagccgctgccccctcgcccccgcccgggccgggagcctcgtccccgtcccccggaaagctggatttccgaggctggaggcgcctggccggctgggtggggaccaccatgggcaacgcggccggcagcgccgagcagcccgcgggccccgccgcgccgccccccaagcagcccgcgcctcccaagcagccgatgcccgcggccggagagctggaggagaggttcaaccgcgccctgaactgcatgaacttgcccccagacaaggtccagctgctgagccagtatgacaacgagaagaagtgggagctcatctgtgatcaggagcggtttcaagtcaagaatccccccgcagcctacatccagaagctgaagagctatgtggatactggtggggtcagccgaaaggtagcagctgattggatgtccaacctggggtttaagaggcgagttcaggagtccacgcaggtgctacgggagctggagacctccctgaggaccaaccacattgggtgggtgcaggagttcctcaatgaagagaaccgtggcctggatgtgctgctcgagtacctggcctttgcccagtgctctgtcacgtatgacatggagagcacagacaacggggcttccaactcagagaaaaacaagcccctggagcagtctgtggaagacctcagcaagggtccaccctcctccgtgcccaaaagccgccacctgaccatcaagctgaccccagcccacagcaggaaggccctgcggaattcccgcatcgtcagccagaaggacgacgtccacgtctgtattatgtgcctacgcgccatcatgaactaccagtctggcttcagccttgtcatgaaccacccagcctgtgtcaatgagattgctctgagcctcaacaacaagaaccccagaaccaaggctctggtgctggagctgctggcggccgtgtgcttggtgcggggaggacatgacatcatccttgcagcctttgacaacttcaaggaggtgtgtggggagcagcaccgctttgaaaagctgatggaatatttccggaatgaggacagcaacatcgacttcatggtggcctgcatgcagttcatcaacattgtggtacattcggtggagaacatgaacttccgtgtcttcctgcaatatgagttcacccacttgggcctggacctgtacttggagaggcttcggctcaccgagagtgacaagctgcaggtgcagatccaggcgtacctggacaatatttttgatgtgggggcgctgctggaggacacagagaccaagaacgctgtgctggagcacatggaggaactgcaggagcaagtggcgctgctgacagagcggcttcgggacgcggagaacgaatccatggccaagattgcagaactggaaaaacagctaagccaggcgcgcaaggagttggagaccctgcgggagcgcttcagcgaatcgaccgccatgggcgcctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgaccggctcccccagcccagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggagtgaaggccaagaagcccatccagactaagttccgaatgccactcttgaactgggtggcactgaaacccagccagatcaccggcactgtcttcacagagctcaatgatgagaaggtgctgcaggagctagacatgagtgattttgaggaacagttcaagaccaagtcccaaggccccagcctggacctcagcgctctcaagagtaaggcagcccagaaggcccccagcaaggcgacactcattgaggccaaccgggccaagaacttggccatcaccctgcggaagggcaacctgggggccgagcgcatctgccaagccattgaggcgtacgacctgcaggctctgggcctggacttcctggagctgctgatgcgcttcctgcccacagagtatgagcgcagcctcatcacccgctttgagcgggagcagcggccaatggaggagctgtcagaggaggaccgcttcatgctatgcttcagccgcatcccgcgcctgccggagcgcatgaccacactcaccttcctgggcaacttcccggacacagcccagctgctcatgccgcaactgaatgccatcattgcagcctcaatgtccatcaagtcctctgacaaactccgccagatcctggagattgtcctggcctttggcaactacatgaacagtagcaagcgtggggcagcctatggcttccggctccagagcctggatgcgctgttggagatgaagtcgactgatcgcaagcagacgctgctgcactacctggtgaaggtcattgctgagaagtacccgcaactcacaggcttccacagcgacctgcacttcctggacaaggcgggctcagtgtccctggacagtgtcctggcggacgtgcgctccctgcagcgaggcctagagttgacacagagagagtttgtgcggcaggatgactgcatggtgctcaaggagttcctgagggccaactcgcccaccatggacaagctgctggcagacagcaagacggctcaggaggcctttgagtctgtggtggagtacttcggagagaaccccaagaccacatccccaggcctgttcttctccctctttagccgcttcattaaggcctacaagaaagctgagcaggaggtggaacagtggaaaaaagaagccgctgcccaggaggcaggcgctgataccccgggcaaaggggagcccccagcacccaagtcaccgccaaaggcccggcggccacagatggacctcatctctgagctgaaacggaggcagcagaaggagccactcatttatgagagcgaccgtgatggggccattgaagacatcatcacagtgatcaagacggtgcccttcacggcccgcaccggcaagcggacatcccggctcctctgtgaggccagcctgggagaagagatgcccctctagcccctcagatctgcggaaccagccctacatccgcgcagacacaggccgccgcagtgcccgtcggcgtcccccgggccccccactgcaggtcacctccgacctctcgctgtagccgctatttctgcaggtggattctgcaggggtgtggggccgtggacaggctgaggctcaaggaaggtggtcctcagctcggctggccgggcagcccctcctccgctgtggcccgcctcaaacgggctggtgcatcctcctcttggccacagagggcagcatcgcccgccccttcccccaaatgctgcttgcagcacccaccctaaagccccctccaaatagccatacttagcctcagcaggagcctggcctgtaacttataaagtgcacctcgcccccgcaagccccagccccgaggaccgtccatggaccttatttttatatgagattaataaagatgtttgcaaaaaaaaaaaaaa

SEQ ID NO: 227 - DNA, 335 bp, Homo sapiens
aaaaatacaataaattattcattctaaccttagcaaaggtacatggattctgtctaccaaatattaattttacagtgaccacaaaaggttatttggttgttacaaagactacaatttgaagatactagataggcaaaaattttgcacttattaatatcgaccaaacacagaaaagacaacagatgtgtttctaaggcacgatttacatactaaattcccttgaaattcaatgcaatttcacttcgctcatgattttcaatcacaagacacctgtgacaaatgaggaacaaatccagaagagcccatctaatctcgtcttaagtggtcccttaaat

SEQ ID NO: 228 - DNA, 766 bp, Homo sapiens
  misc_feature (691)..(691): n is a, c, g, or t
  misc_feature (708)..(708): n is a, c, g, or t
  misc_feature (717)..(717): n is a, c, g, or t
  misc_feature (731)..(731): n is a, c, g, or t
  misc_feature (759)..(759): n is a, c, g, or t
agaagcagccattatacttctaagctgtgccaactaagtggttcccatttctggagccagagatgataattaagtcattgcaagttgcctgaagagaattactcaggcaactgggaaaggcagtggaaggtctgtgaagcaaagttttcaagtagatattgctattactggcaggtgtgcaaggcgtgtagtaaaatcagtttgtggcataggtcggcccttgctgactaaatcctctctggggattgaattgatgacgactgtgacttgagttggattcgaaaatggcttcccttggcctcttgaaagagtgcagatgaagccttttccgtggatttcagtaactttccagcataccatgacgatttcttccccaaatatacacatgctcttttgctctttgtgcctgatcttcagtaatttttagttttttaacaggcagaaaaaatctagcagctaggaaagttcaagttggggtggggagtttttagtgaacttttctcccaggtgtgtggcctttatttctatttatatatgtttgtaaatggaattaccccctttctcttgcaaaataaccgcttcctggctgttggctcactttgctggaatttttctgaatccaggttaagatttccagaagtcagctttggaaaacgtgacactcctaccaaagtccagatggttagaaagntatcacataccatgggntttcagtgnttttggaaacccgnttttttctggtttttttttccccctctncatttta

SEQ ID NO: 229 - DNA, 4965 bp, Homo sapiens
  misc_feature (3757)..(3757): n is a, c, g, or t
  misc_feature (3810)..(3810): n is a, c, g, or t
  misc_feature (3881)..(3882): n is a, c, g, or t
  misc_feature (3892)..(3892): n is a, c, g, or t
acctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcggaggcgcgcgcccgctgccgggtccgccgcgcgcgctccctccgctcctctcccccgcccctcccgggcccgcgcgctcccagggtccgccgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctggccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaagtgaatgttatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcgtcgacgcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtncaaagtcatttcggccagtaggtgtgcagacccctcccccgccacgatcgtcnctgttgcttggtgtgtaggaccctaggctccccgcccaccctctgcctggtcgcgctcttctgtcccacgnnggagctgacnccttcctctctggccgcccatccggctcgcacaggggcctcccagcgcctcaggccccgcgtttgtgtctggagtctccccccggggagaggacctggccccattttccacactcctcctccgacagcagctccctgggcagtggcctgctctcaccgtgtgcagccttgtggtttatgcttaaatgtacattttcctgctggtaaaaggagaaactgagaggtgtcctgcagaccggctgaccactccttttggagacggcaggaggcctgagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaaaaaaaaaaaaaaaaaaaaaaaaa

SEQ ID NO: 230 - DNA, 3828 bp, Homo sapiens
cgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggcgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgacgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctagggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttttaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagattgaaaaaaaaaaaaaa

SEQ ID NO: 231 - DNA, 6565 bp, Homo sapiens
  misc_feature (3839)..(3839): n is a, c, g, or t
tattttgacatgcaagaggagcaggcattccaggtatttgaatactgagagattcaaattatcagcaaggttctttccagttccacgtttgttgtgttatcagtgtaaaattatttgaatagctttccactgatgagttattagctgataagtgtttattgtcatggttgaaagaaaataataatgaaagaagaaacgattacctttagtgataaagttggggccggatgggacgaagcagtgcaatttttttctttataattattcccctatttgaaaaatcaacttgtatatgaggcagcaaacaccttgcagagcagcattcccttttagtttcaggacgtggtggtggatggaaccactgtaacctggcctccctccatgagaggagggaatccaggtggccatgttgaaatgtgcctgtgtgcagcaaggcttctgaaatgacaagagagcccagcagcttccaaagcagctgtgactctggatctcacccatcatctctgcttctcactgttagaggagtgaatctgtgctgccttaggaggcatggaacctgggacttttcttccttgtttaatgtttaattttattaaaataatttgtaagtgatagatgttgatctcgtgacaaaagagagattccctctttataaaactattctaactaaagatcttttgtaagcccatgtgttagaaataaaacttgaatatccccttttttgttgttgtttatgaatggccaataatttattcacatgtgacatttgagctggcattttttcctcctgagatgacagtagcgtccgctgtgttgtattctaaagcaaagtcagaatagccctttgcttttgtcccgattagtagttctgttttgccttcttgccttttccatttagaccttatggtatttcctaaaccttagactgttttgaaaggctttgattaaaatatgctgataaaagaattcgataaccaagttaggaacgacaaggctatctggagaagaccaaatgacttggcagcctaacaaattctattcagagcacacaaagagatcctggaacgttttatagggactcgtgtgtggggaatggtatgaactcaggttacctgcaaaatatggtgtcatatggaaacatttaagagcttatggaaaattctttgaaataaagtggaatgagctagcaagcatattatacctaagaagaaaaacaagagcattcattctggttttttaaggtagctgctcaaggaagggagatagatgaaagtaaattgttttctactttgtacacataatatagaagagatcacctaagcctagttttgctaaccagaccctagacttaaaattagaggtcatgatgtctagccaccttcctctgtaggaacctctcgtgataccctgaaagcctctgcttaaatacttccagagaaaagtgaggaaggtaggggtggggatgaaggtttgcaggaactcatgttgagtacctagtatctgcaagatactagagtaggtactttatcgccatctcatctgacttatgtatgagtgcaggttttataaccctcaagtttacaagtgaggaaactaagtttatataagtgtcacgaaacttgcttcagttcagatgtctagcttgaggcaaatctgaaattagaacctaggtccatcttcttgcattacactaaactgcctctcaggatgagggagagctcccttcatggctaaggcaacctcttctgtctaataatgcagattctttaaaaattctttcttttatttaactgaaatctgcctcccattaacatctctcattggtcctgattcggcctcaggaggatcacagagctgatgcaattctctttccttatgcaggtatgtttgcaaccactgctgccaaaatggcctctgccatcttttacctagttggttttttttgaaaatgaacacacacacacacacacacacacacacacacacacacactctcacacacacacactcacagaaatatcctcttattgactgcaatccatctttcaacatatggagttctttttgaatactagaggtatagccttaaagaatatgagtatcagaagatactttagtttcatctttccctgcctgattcatcagccaattgttagtatgccatcagtcaagccattaataaaaataatgaacaaggtgaacaggataggttaacttgtagtctatgtataagtttccgaggttgcatgcagaatttagcctatatgtgaatttttctggaaaaatggtcagtaactattgtcagattcctttttttttttttttttttttttgaagacaaagtcttgctctccagcctgggtgacagggcaagattccatattaaaaaaaaaaaaagtattgagaagtactcagagtagagaacttactcccgaatgaatatactaacctctttgaggagagctccccaaatgaccataaattcatatagctcagccatcactagaccgtgtatttcagccagaagatatggtgaatggtcttgtaagatgcctgactaaattaaagtattaaagtatttcttgaattctcttgatattcctggactttgagaaagaataattatgcccttaaaaatggaaaaagagactgcaatattgttatacaggccttttaaaaaaaaagtatccttaaatttttagttacagagttcacttttttcccctacttttctttgttttagattataagcccaggattgttcaccagaaggttaccctttagtctgcaggaacctttgaaaacagatgtggtattgaagaatatctctgtaagcccagaacttatccattgtataaagaattttattttccccagtagaccgggagctcctcaagggcagggacctttgcaagtctttgactccctagcactgaacccagcatctggcaaatcttatttcatgtgactttattttggctgaatggcctaaaaatgcgcttgtactgagcacctaatacatttaatttaatttttaaatttttattcaataatatagacatggagtccccctatgttgcccacgctggctcaaactcctggcctcaaggatgttcctgcctcggtctcccaaagtgctgggattacaggcatgagccactgcaccaagccctaacacatttaataaattgtaaggaggaagaacagtggaccgcagtgagatatggtctacagggaaaatgaagaacctcttcaaaaatgatgatcttcaggcctgtaatcccagaactttgggagccgaggcgggtggatcacttgagcccaggagttcaagaccagcctaggaaacatagcgaaaccacatctctaccgaaaaatacaaaaattagccatgcttgtagtcctagctattaatacgtgggaggctgaggtgggaagatggtttgagtccgggaggtggaggttacagtgagccactgtaccccaacctgggtgacagagtgagaccccatctcaaaaccaaaaaagatgacctttattatgtttgacttttaaaaaaatgtagccaaagtaaaagtgttgattagcataaccccgatcacatgttgttgttgaaaatgagcactggcttgcataaaatggacattcatggacatgaaatggacattaatgattttacatatgttaagaagagaattttagacttgagaccttagggagatctgttgatagaattccctatgctctacagataaggatacttagtgaagggactttcctaagctcacagacccagaagagtagtactctttccagccaatggtgatgcttacttatgnttttttttttttttttttttttttgagacggggtcttgctctgtcgcccaggctggagtgcagtgacacgatctcggctcactgcaggctccgcctcccgggttcacgccgttctcctgcctcagcctcctgagtagctgggactgcggacgcccaccaccacgcccggctgattttttgtgtttttggtagagacggggtttcgccgtgttagccaggatggtcttgatctcctgacctcgtgatccgttcgcctcggcctcccagagtgctgggattacaggtgtgagccaccgcgcccggcctacttatgtgttttagaaaaatctttaaaatgttaaaagatgacaggtaatttctagaccatatgaagtagcccagttgtcccaggattagtttattatgtgtatatcagccattattttacagagtcatctcacataaatccacacaaccttaaaggattaaaggatggtttctgtgcaactgaaacatatgcacagaatgacaatagtcgtgatactttctttattcttttttttttttttttgagatggagtctcactctgtcgccctggctggagtgcagtggtgtgatctcggctcactgcagcctccatctcccagattcaggcgattctcatgcctcagcctcccgagtagctgggattataggtgcacgccacccgcctgggtaatttttgtatttttagtagagatggggtttcagcatgttggccaggctgatcttggaactcctgacctcaagtgatccgcccacctcagcctcccaaagtgctgagattacaggtgtgagccaccacgcctggccagtcatgctactttataatctgaagttaccagttctttgcagtgtttcacattaggggcattctccaaagggaactttagagataacaaatatgttaaaaatatcgaataaagttagagatgtggggagacattcctactcctacagagagcaaccataccttcctatagactgtgcactgaagaaagggcggaggggatgcgcctgttagagttagaatcttggcttgataggcaaggaaattgacccggtgtggtggttcttatattggtaagaagacccttctttggtttctttttttccagatagctaaagtcaatgtcagtgattgcttcaagcatgatagtcttaccagcctacactctaagcttttcttatgcttccagaatgacttactcagcaatcacttctactttgtattaaaacagttttggttattcaggtaggaagaagagaaaaaaaccaggctgtttccagttgtctggggtttacattatgttacctctcagactgttagtgaaatcagggagactagtggtttttacggcatcagagataccaaatgtataacagacagatgtcatcttactctttttaagtcatggacaaaaagacagacacattgccctgtaactttcagatcttctgtaacctttttaaacaacataggagagaagttggtacttgtacccaagggaagagaaagttaatgagtagaaaagacagaatttatttaggaaaacgatggaattaagctctggacaaaacatgcatcagtgatgcataacatttttgttaattgggtcttaacaggtttctgactcatatggtaatcattgtagaagtgggtcttactagaccacgccagtggcaaatcgcgaagctgtaagaactcttacctccctgtgtgtgtgcacctgagtgtgtgggggggcgtacgtttctgtagcttaatttaggttccacatacacttcagtggttaaacctgagctagactcaaatagtttgtttccattaagaaaatgaatcttttatgtggaccaaggtcaggttagttaatttgtttgcttttattggaataacttttcccattccaattcatcacttaattttaagtggttctactaaaatacccattaaagtcctttacatttctcacagactagggctatgacagattcataagacgtttcttttttcctcaaggcacaaaaggtagcttttctggtcatcaacctagtcttccttgttcctaatttcacaacagtggggcaacattttatataataccaatatgaactctaattgcaaagagactaaatgaaatcttcacacgaagcaagattaattaaaatataaaatgtgcttgactgtggtaaaacatttcttttaaaaaaaatagtatgacttttttttttttttttgctaaatctttcttttttgtacacctcaccctcttcttcactgatgcattttccagcaactggaagttcactctggctaggaaagtaactaaatgtgatgttatcattctaattagtgattacaaaagatcaattaatgttataattaaaaacagtgtctagatctgttgtttgtagtgaataaatgtgacaattactttgttcattgacatagatgtgttgaatttcctccctagattttaaggggatgcattttagtgctgatgtgtgcatttaactgtggacagtaggaacaaggcaagcatattaggggaagagtagggcccctaatgtctaagctacagacatattttagcatgcttgacacctttccttggtatatgatgctatatcagcaacttgtactcattggatctggagcctctagcttttaatattttatcactaaatgcttaagtgtttatgttgc

SEQ ID NO: 232 - DNA, 3460 bp, Homo sapiens
agcgggacgcccgggcggccctgaaggggacggggcggccccagtcggaggtcgcagggagctccgcccccgactcggtataagagctgggcccggcccacggcggcggcggcggcggcggagagagctggctcagggcgtccgctaggctcggacgacctgctgagcctcccaaaccgcttccataaggctttgcctttccaacttcagctacagtgttagctaagtttggaaagaaggaaaaaagaaaatccctgggccccttttcttttgttctttgccaaagtcgtcgttgtagtctttttgcccaaggctgttgtgtttttagaggtcctatctccagttccttgcactcctgttaacaagcacctcagcgagagcagcagcagcgatagcagccgcagaagagccagcggggtcgcgtagtgtcatgaccagggcgggagatcacaaccgccagagaggatgctgtggatccttggccgactacctgacctctgcaaaattccttctctaccttggtcattctctctctacttggggagatcggatgtggcactttgcggtgtctgtgtttctggtagagctctatggaaacagcctccttttgacagcagtctacgggctggtggtggcagggtctgttctggtcctgggagccatcatcggtgactgggtggacaagaatgctagacttaaagtggcccagacctcgctggtggtacagaatgtttcagtcatcctgtgtggaatcatcctgatgatggttttcttacataaacatgagcttctgaccatgtaccatggatgggttctcacttcctgctatatcctgatcatcactattgcaaatattgcaaatttggccagtactgctactgcaatcacaatccaaagggattggattgttgttgttgcaggagaagacagaagcaaactagcaaatatgaatgccacaatacgaaggattgaccagttaaccaacatcttagcccccatggctgttggccagattatgacatttggctccccagtcatcggctgtggctttatttcgggatggaacttggtatccatgtgcgtggagtacgttctgctctggaaggtttaccagaaaaccccagctctagctgtgaaagctggtcttaaagaagaggaaactgaattgaaacagctgaatttacacaaagatactgagccaaaacccctggagggaactcatctaatgggtgtgaaagactctaacatccatgagcttgaacatgagcaagagcctacttgtgcctcccagatggctgagcccttccgtaccttccgagatggatgggtctcctactacaaccagcctgtgtttctggctggcatgggtcttgctttcctttatatgactgtcctgggctttgactgcatcaccacagggtacgcctacactcagggactgagtggttccatcctcagtattttgatgggagcatcagctataactggaataatgggaactgtagcttttacttggctacgtcgaaaatgtggtttggttcggacaggtctgatctcaggattggcacagctttcctgtttgatcttgtgtgtgatctctgtattcatgcctggaagccccctggacttgtccgtttctccttttgaagatatccgatcaaggttcattcaaggagagtcaattacacctaccaagatacctgaaattacaactgaaatatacatgtctaatgggtctaattctgctaatattgtcccggagacaagtcctgaatctgtgcccataatctctgtcagtctgctgtttgcaggcgtcattgctgctagaatcggtctttggtcctttgatttaactgtgacacagttgctgcaagaaaatgtaattgaatctgaaagaggcattataaatggtgtacagaactccatgaactatcttcttgatcttctgcatttcatcatggtcatcctggctccaaatcctgaagcttttggcttgctcgtattgatttcagtctcctttgtggcaatgggccacattatgtatttccgatttgcccaaaatactctgggaaacaagctctttgcttgcggtcctgatgcaaaagaagttaggaaggaaaatcaagcaaatacatctgttgtttgagacagtttaactgttgctatcctgttactagattatatagagcacatgtgcttattttgtactgcagaattccaataaatggctgggtgttttgctctgtttttaccacagctgtgccttgagaactaaaagctgtttaggaaacctaagtcagcagaaattaactgattaatttcccttatgttgaggcatggaaaaaaaattggaaaagaaaaactcagtttaaatacggagactataatgataacactgaattcccctatttctcatgagtagatacaatcttacgtaaaagagtggttagtcacgtgaattcagttatcatttgacagattcttatctgtactagaattcagatatgtcagttttctgcaaaactcactcttgttcaagactagctaatttatttttttgcatcttagttatttttaaaaacaaattcttcaagtatgaagactaaattttgataactaatattatccttattgatcctattgatcttaaggtatttacatgtatgtggaaaaacaaaacacttaactagaattctctaataaggtttatggtttagcttaaagagcacctttgtatttttattatcagatggggcaacatattgtatgaagcatatgtagcacttcacagcatggttatcatgtaagctgcaggtagaagcaaagctgtaaagtagatttatcacacaatgactgcatacagacttcaaatatgtcaatagtttggtcatagaacctagaagccaaaagccacacagaagggcaagaatcccaatttaactcatgttatcatcattagtgatctgtgttgtagaacatgagggtgtaagccttcagcctggcaagttacatgtagaaagcccacacttgtgaaggttttgttttacaaatcacttgatttaacacactcaggtagaatatttttatttttactgttttatacccagaagttatttctacattgttctacagcaagaatattcataaaagtatccctttcaaatgcctttgagaagaatagaagaaaaaaagtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatcttaaaaaaaaaaaaaaaaaaaaaaaaaaaa

SEQ ID NO: 233 - DNA, 1291 bp, Homo sapiens
ctgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctgtacattgactgattcactttttcataaagtgagcatttattgagcattttttcatgtgccagagcctgtactggaggcccccattgtgcacacatggagagaacatgagtctctcttaatttttatctggttgctaaagaattatttaccaataaaattatatgatgtggtgtctcaaaaaaaaaa

SEQ ID NO: 234 - DNA, 1041 bp, Homo sapiens
aggggcattatggactatgaaacgttggtagaaaaagcaggctggtaccggtccggaatcccgggatatcgtcgaccacgcgttcgatgaacacatcggccatgctgtcttgagatgaatgaacacatcagccatgccgttctgagatgaatgaacacatcggccacgccgtcttgagatgaatgaacacatcggccatgccatcctgagatgaatgaacacattggccatgctgtcttgagatgaatgaacacctgggccatgctgtcttgagatgaatgaacacctgggccatgctgtcctgagacgaatgaacacctgggccatgctgtcttgagatgaatgaacacatcagccatgctctcctgagagggatgaacacctgggccttgccgtcctgagatgaatgaacacattgaccatgctgtcctgagatgattgtcctggttatgcagacatttctttatattatttgcttaaccttaatgccctcctaggaagatttcccatactttcctcccttcaatcaaaatatcccaagttcaacaggtctggctcactcctctctattcatctaaggtctacttgttcaggaatttctgtctaggactcaggcaggaccaaggaaatcttttcagtgacattttaaatatcactgtttatggaatgtgtatagataactgaataaccaaataagtgtggtttgaaagtatctttattaaaagaatataaaagaacacgaacaaaaaataacaggggggcgtctagagtatccctcgggggccaagttacgcgtacccggctttcttgttcacacgtggtcctaaaggagtcgattaaagctagcactggcgcgtttacacgtgtgactgggaaaactgtagctcggatctgggaaggcctacttctggggtgaattatctggcactactacgagattaggtaggattaaattaggtctgtcaccacgcatctgtccgatgcttggtataataaccataaataaaagaagaaaaggcgaatccaaacacaacaaaataa

SEQ ID NO: 235 - DNA, 3119 bp, Homo sapiens
gtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 236 - DNA, 1018 bp, Homo sapiens
  misc_feature (1)..(1): n is a, c, g, or t
  misc_feature (520)..(520): n is a, c, g, or t
  misc_feature (532)..(532): n is a, c, g, or t
ntcgtgcattaaccctcactaaagggaataagcttgcggccgcaatgtttttttttttttttttttgtgagcaacaaggccgtttattcacttgggtgttagtgggctgaatcggaaaagggagtcagcccggaggtgtgagggagagcagtctttacagggcaaagtggcgggtggaaaattacaacatggttttgggacttgttgactcaagaagttgatcaaccagttggaacagaaacccgttgttcttcttttgtggtttttggttgttgcaggttttctggttccaggaagtctggaggcatatgtgctggtcacagagttcttaatggcccaccgtcaataatggcctgctggcaataatgcagccatatttgtgggatatgacattcctgtctttttgttttaataagaaaagaagtggacggggtgatgtttctcagggattcttcgagcgggacttggggcggcatggactcctaattgggagagagatccctcgtgccgaattcttggnctcgagggccanattccctatagtgagtcgtattaaattcgtaatcatgtcatagctgtttcttgtgtgaaattgttatccgctcacaattccacacaacaaacgagccgggagcataagttgtaagcctggggtgcctaatgagtgagctaaccaaaataattggtttgcgctcacggccgctttcagtcgggaaactgtcgggcagcggattagaatcgcacacccgggaaggggttgctttgggctctccgctcccgcaagaacctggccggcgttgtggggagggtaatcaccaagggtaacgttccaaatcagggaccggaaaagtgtgaggccatgccgactaagcgctggggtttcagtcgccgaggtcaaatcgccataggggttccgggataatcaaggttcccggcccgcctctgtgtcggtggatgctttcccgaagggtcttgcgaggccccggtgtcccgggttgacccctcgtgcgtgttattt

SEQ ID NO: 237 - DNA, 5106 bp, Homo sapiens; identical to SEQ ID NO: 31

SEQ ID NO: 238 - DNA, 725 bp, Homo sapiens
gtgtaggccaagctaaaattaaccctcactaaagggaataagcttgcggccgccaactttttttttttttgcttacctataaaccagtggaaataaatacataagattagttaggggtttattgaggcttgaattctagaaagaggggaattactatattatacacaagtgccagttaaacatgtaccaatctgaagaagatctttctatacctgctactaatcatggaaaacaattaacttactggtttttgttatataaatacatattaagatctgaaaatctcagcagttagttttatttataatcagaaagacagatgttaacagtcactgaaaatctttatgttttaaatgaacgcaccttcacttttacttgacttctacttcatcagcataattggagaaccatagattctttccccatgagtgagggcaaaacatacatctgcagtgttcttagcatgaggatcattaagatggcagaccttgtagatcaaacaatttcctcccatacaccctcattctttcctagaaaagcattgagacagctctgaaattagacctggaaagcatgtgctaaggcaagaacaaatatcttgaaaaatttatcacaatgttgcttttttaagtccaaatgtcctctaaaatgaaattctttggattaactttcttcaaagccgggtttcacaactggaaattgctgattgacttccaaggactgta

SEQ ID NO: 239 - DNA, 7272 bp, Homo sapiens
ctcccgcgatgggaaaagttggcgccggcggcggctcccaagcccggctgagcgcgctcctcgccggcgcggggctcttgatcctctgcgccccgggcgtctgcggcggcggctcctgctgcccctcgccgcaccccagctccgctccacgctcggcctcgacccctaggggcttttcccaccaggggcggccaggcagggctcctgccacgcccctgcccctcgtagtgcgtcccctgttctcagtggcccccggggaccgagcgctatccctggagcgggctcggggcactggggcatccatggcggttgctgcacgctccggccggaggagacggagcggagcggatcaggagaaggcagaacggggagagggcgcgagtcggagcccccggggagtgctaagagatggagggcagcaggagcctgggactcgggagcgggacccggacaaagccacccgcttccggatggaggagctgagactgaccagcaccacgtttgcgctgacgggagactcagcacacaaccaagccatggtccactggtctggccacaacagcagcgtgattctcattttgacaaagctctatgactataacctggggagcatcacagagagctcgctttggaggtcaaccgattatggaacaacctatgagaagctgaatgataaagttggtttgaagaccattttgggctatctctatgtgtgtcctaccaacaagcgtaagataatgttactcacagacccggagattgagagcagtttattgatcagctcagatgaaggggcaacttatcaaaagtaccggctgaacttctacattcaaagcttgctttttcaccccaaacaagaagactggattctggcatacagtcaagaccaaaagttatacagctctgctgaatttgggagaagatggcagcttatccaagaaggggttgtaccaaacaggttctactggtctgtgatggggtcaaataaagaaccagaccttgtgcatcttgaggccagaactgtggatggtcattcacattatctaacttgccgaatgcagaactgtacagaggccaacaggaatcagccttttccaggctacattgacccagactctttgattgttcaggatcattatgtgtttgttcagctgacatcaggagggcggccacattactacgtgtcctaccgaaggaatgcatttgcccaaatgaagcttccgaaatatgctttgcccaaggacatgcatgttatcagcaccgatgagaatcaggtgttcgcagcggtccaagaatggaaccagaatgacacgtacaacctctacatctcagacacacgtggtgtctacttcaccctggccttggagaatgtccagagcagcagaggccctgagggcaacatcatgatcgacctctatgaggtagcagggataaagggaatgttcttggctaacaagaagattgacaaccaagtgaagactttcatcacatataacaaaggcagagactggcgtttgctgcaggcgccggacacggatctaaggggggaccccgtgcactgcttgctgccctattgctcactacaccttcacctgaaggtctctgagaatccctacacatcagggatcattgccagcaaagacacagctccaagcatcatagtggcatcaggtaatataggttctgaattgtcagacactgacatcagcatgtttgtctcttcagatgcagggaacacctggagacagatctttgaagaagagcacagtgttttgtacctggatcaaggtggagtcctggttgctatgaaacacacatctctcccaattcgacatctttggttgagttttgatgaagggagatcttggagcaaatacagtttcacatctattccactttttgtggatggggttctgggtgagcctggagaagagactctcatcatgacagtgtttggacacttcagccaccgctctgaatggcagctggtcaaagtagattacaagtccatttttgatagacggtgtgccgaagaggactacagaccttggcagctgcacagccagggggaagcatgtatcatgggagcaaaaaggatatataagaagcgaaaatcagagcggaagtgtatgcaaggaaaatatgcaggagctatggaatctgaaccctgtgtctgcactgaggctgattttgattgcgactatggttatgagcgacacagcaatggccagtgcctgccggcattttggttcaatccatcctctctgtcaaaggattgcagcttgggacagagttacctcaatagtactgggtacaggaaggtggtttccaataattgcactgatggcgtaagggaacagtacactgccaaaccgcagaagtgcccagggaaagccccgcgggggctgcggatagtcacggctgatggaaagctgacagcggaacaaggacacaacgtcactctcatggtgcaattagaagagggtgatgttcagcggacactcatccaagtggactttggcgatggtatcgcggtgtcttacgtcaatctcagctccatggaagatgggatcaaacacgtctatcagaacgtgggcattttccgtgtgaccgtgcaggtggacaacagtctgggttctgacagcgccgtcctgtacttacatgtaacttgtcccttggagcacgtgcacctgtctcttccctttgtcaccacaaagaacaaagaggtcaatgcgacggcagtgctgtggcccagccaagtgggcaccctcacttacgtgtggtggtacggaaacaacacggagcctttgatcaccttggagggaagcatatccttcagatttacttcagaaggaatgaataccatcacagtgcaggtctcagctgggaatgccatcctacaagacacaaagaccatcgcagtatatgaggaattccggtctcttcgcttgtccttttctccaaacctggatgactacaacccggacatccctgagtggaggagggacatcggtcgagtcatcaaaaaatccctggtggaagccacaggggttccaggccagcacatcctggtggcggtgctccctggcttacccaccactgctgaactctttgtcctaccctatcaggatccagctggagaaaacaaaaggtcaactgatgacctggagcagatatcagaattgctgatccacacgctcaaccaaaactcagtacacttcgagctgaagccaggagtccgagtccttgtccatgctgctcacttaacagcggcccccctggtggacctcactccaacccacagtggatctgccatgctgatgctgctctcagtggtgtttgtggggctggcagtgttcgtcatctacaagtttaaaaggagagtagctttaccctcccctccctccccttctactcaacctggtgactcatctctccgattgcaaagagcaagacacgccactccgccttcaacgccaaagcggggatctgctggggcacagtatgcaatttaaggaaaacccccaaaggctacaggcgacctgctgatcaggaaagaatttcgctcttgtcaagtacatcatccttcatgaccactaactttgtgttttttttctttcctttgttgttctgtttcctattttgccaggaagtatttccatagttgctgagaatcaaagcacaaaagaaatccctacctatgtaaatgtttgaatggaggacgccagtaaaaaaacaaaaacaaaaacaaaacaaaacataaaatataaacaatcaaaatccaaacaaacaaacaaacactcactgcatcgggactttttaattcttcagacacagacaacaagggtttttagctttaagcctgtgcatgtggacaatactctgagaacatgtctggaggggcagtgtacaggtgctctattttaatggaaaacactcccctctccctctttcttcttctctctcttttttctgatcggtcgtgtttgtagaaaattcataacatatataggccaaggaaatctgcatgtatttttggaaatattcttggctctagatttatcagctattttagcattaaaggctgatgggtggattagctaccccagctcctttcataagacacaaagacgtgcacaggagtttgaaaccctgagctgtttctctgttccactttccatactgtcatttcccttctaagttagctttggtagctctgttggtcagcagtggccacaaggctgctttctgcactctctgtggccacaggaacaaagatgcgagttgaagatccctttgtgccggtagaataaggaaggaagggaggcagggaggcaaagcatgtcagaaacggaccttggtttcctgttcacctctttccaccatgattgcctccccttgcagctttccctactcctgccccaactgcagtaggaaatggaatcccattagttacccattgtcctgtcttcacatttgtttgtcatccatgtgtgaccatgatctgttgatatctttgaatctcttccctccaaaccccaagtaagttgtccttcaactgttctcagtttttcttcccaaacatattgctagattctggacattaaccctgacgtttcctaaatactggcctggcctgtgccgcccctgcccccactactcacaagtttctgagccctttgtcagttttgtacattcccaagcatgccagcttctgtgcccatggaccttgctgcatcctgcacagcagggttcagtttcatgtatctttgtcttttcctctagaacctgcctttttcaaatatccctgccttttcccacctggaaacatatactgtatgcgaaagagttgatatatgcaaagtaattcaaacctggccatgtactttggaaaagaaagcatagagatgaattgtggtgttctcacaccttaacgaaaatctcgtgcgatctgattccagaagattcttgtgagaaatgttttgaatgtgtgacaatttcgcagggcaatttcctcctgtgacggttgctgttacctggtatttccactctcacagtagaatagaaatgtttgtgaaataaaactgattttaactggaaggagaaacaggttaatggactttgtgtttaagagtgtcaaacagtctgagagaataaatgggggtcttgtcttacattagggtgagagtttgattatttaggatgatcccagtgatttcatgtgtgctctctgacctctgagtatcatagtatcattaaagtaaagatttaagtctgtataaaggaggagagttactgattggcaaaaaagattggcacaaagcatgaagaaaccccatttttcccagggtaatcatgaaagaaggctcagagaaagagggaaacaaaagcctgttcagcagaggcccctttagtattatggactgggcaaagcccactataaactataggagaaagaagttctgataaacctcttagtatgctcagcctccttctttgctatgtccctaagccaacagggtataacacaggccctggtgataatgagggtgtcctaaagatcctgatgtccatgacttcatgtagttcaggcacagaaagaatagcaaagctgctgtcagaagtttgtcaggcagagatgtttatggttgaggataccccatatgaatctgggaaatgggctaggcctgaggcagtcacctatttgtagaactcaattgatccccaacctgccaggcttcctatctcataggaaacatcctcattgatcctcttcagttggagtctcccaaatttaatgtggaagacaaagtgttggaaaatcaaaagaggctcactcaaaccagcacagggagtcctcagagttgcagttcaattcattttaattagaaaagtatgaaagaggtataacactcttattctagcacagtgccttgcctagagtagtagtatgaaaactatttgttgaagaaataaatgaatggaaagacatagggaagaatgggctgtaaatcctaattaaaaatagaggtcgacatgagatacctggcattttgggaagtgaccaaagatggccagctagagattcagcatctccaggatcctcatgtgcctctcctcaaagctccctcccatctgtaggagattagtgaggcaaggtgctgctcagagaggaggacctcattgttcttaggaccttggccagttgttctcaaagtgtggtacctggatcagcagtatcactatcacttgggctagttagagatccagattctggatccataccccatacctactgaattagaaactctaggggatgaatagtggtgttctctgttgctaagtgacagtgggcccagccacctattttaacaagccctcccagtgattgtgatacatactaaagtttgagaaccattgtactaggccattccagctgaatctcaaacagaaggcagtaatgagagcctacaaatgggagggacctaagtgcctacctactcgctaatcgcaggtgcaaacacacaaggagtttggtgggcttaaggtcagaggagtgtgtagggagggatgtatgtggaaggtaagattcagggcaagctaaaaatccgatactgcaacgttttccaaaatcccagaaggcaaactgtgcatgttctaccctgaaccacccaagcaacactttctaccttgccttatttttaattggattcactgtccaaaatgcagaggtttgctttgcttttttttcagaagttccaaacagcaactttgagagcagtggggtgcttggcagctgttctgtgttttccaggaatccaactgagcattgaaatctctcatttgccgacttatttttataggaagccaattaaaaaaaaaaaaagttttcttatagtattggaactacttctaattttaaaatgacttttttgatgtattttttgttaaatactatgtagtgtaatgtataattgctcttgtttattgcttttacaatcatatttattaaacagataatgtctctaaagtctttgcctcaggtatttttttttttaatcctaaacccttggtgttcattctaaatatagaagtgttgcatgtataggatttcataaaggctaattgcataagaaagagtaaacaccacaggcttgaggtttttggctgttttttactaacaaggcagaatgtatgtactacctgaattctacctgcatttcaattaactatacaatgtctgtttattaaattactttgatttaaaaatta

SEQ ID NO: 240 - DNA, 6671 bp, Homo sapiens
cagagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggtcagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcaggtgagaattttaaagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagagataaaaaaaaaa

SEQ ID NO: 241 - DNA, 890 bp, Homo sapiens
ggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagca

SEQ ID NO: 242 - DNA, 4296 bp, Homo sapiens
cactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaaaaaaaaaaaaaaaa

SEQ ID NO: 243 - DNA, 4261 bp, Homo sapiens
actcactgagccccaggcccaaggataatgatgtgttgtttcttggtagcataatttgtcacacgtacattttttcttcttcttctcttgcagaaagctctgctccctctctctctccctctctctttctctcttttctccctctcctacattttcttgctgttgctaattcatggtgatcaaatgatgtacgacaaaataaattgtaaagagtgactgcctggagttgggaaccagaaggtgttttccccctcccaaggagacagcaaacctttaaaaaggaaggacaattgatttttggggggagcttaagtgagccttgactttgcagctggttgagaacaggttggaggagggtttaaagccaggtgcaccgagtcagctcgccatgtccagatccggggacaggacctccaccttcgaccccagccacagcgacaacctgctgcacggcctcaacctgctgtggaggaagcagctgttttgcgacgtgaccctgacggcccagggccagcagttccattgccacaaggccgtgctggcctcctgctcgcagtacttccgatcgctcttctccagccacccccctctcgggggaggggtcggcggccaggacggcctgggggcccccaaggaccagcagcagccgccgcagcagcagccgtcacagcagcagcagccgccgccgcaggaggagcccgggactccttcttcctcccccgacgacaagctgctgaccagcccccgggccatcaacaacctggtgctgcagggctgctcgtccatcgggctgcgcctggtgctcgagtacctctacacggccaacgtgaccctgtccctggacacggtggaggaggtgctgtcggtcagcaagatcctgcacatcccccaggtcaccaagctctgcgtgcagttcctcaacgaccagatctcggtgcagaactacaagcaggtgtgcaagatcgccgcgctgcacggcctggaggagaccaagaagctggccaacaagtacctggtggaggatgtgctgctgctcaacttcgaggagatgcgcgccctgctggactcgctgccgccccccgtggagtcggagctggcgctcttccagatgtccgtgctgtggctggagcacgaccgcgagacccgcatgcagtatgcgcctgacctcatgaagcgcctccgcttcgccctcatcccggccccggagctggtggagcgggtccagtcagtggatttcatgcgaaccgacccggtctgccagaagctgctgctggacgccatgaactaccacctgatgcccttcaggcagcactgcaggcagagcctggccagcagaattcgctctaacaagaaaatgctgttattggttggagggctgcctcctggaccggaccggctccccagcaatttggttcagtattacgacgatgaaaagaagacatggaaaatactcacaattatgccatacaacagtgcccaccactgcgttgtggaggtggaaaacttcttgttcgtgttgggtggagaggaccagtggaatccgaatggaaaacacagtacaaattttgtcagccgatatgatcctcgatttaatagctggattcaacttccacccatgcaggaaagaagagccagtttctatgcatgtcggttggacaagcatttatacgtaattggtggaaggaatgaaactggctacttgtccagcgtggagtgctataacctagaaacgaatgaatggcgctatgtgtcctctttgccacagcctctggcggctcatgcgggagcagtgcacaatgggaaaatatacatttcagggggtgtacacaatggagaatatgtcccatggctatattgctatgacccagtaatggatgtctgggctcgaaaacaagatatgaacacaaaacgtgcaattcacactttggctgtaatgaatgatcgcttgtatgcaattggaggaaatcatttgaaaggtttctcccaccttgatgtaatgcttgtggaatgctatgacccaaaaggtgaccagtggaatatactccaaactcccattttggagggtcgaagtggccctggctgtgcagtgcttgatgacagcatttaccttgtgggaggctacagctggagtatgggggcctacaagtcatctacaatatgctattgtccagagaaaggaacctggacagaactcgaaggagatgtagcagaaccgttggcaggccctgcctgtgtgacagttattctgccctcttgtgtaccatacaacaaataacaccaggaaactctggaatgaacagtatcacattctaggaagcaatggcaggtgacatcactattataataggaacaatgcattctaatggtacaactgccaaaacccacccttggtttctgatgatttataagtaactacaaaagaaagagacctgttcttgaacagatactatgtctataactcagatcgcaccaaacttcctgtggtgacagactcttccatttcagactggttttaacttatcccagctttacaaaaactcttcatgtgaatcttaacttgcaaaaggagaaagataaaatacagaagactggccccagagagacctcagatcagtattgtgcattgtagtctacctgcatgtgatctatgttgacatttcggggatattgtgttcaagaatgattccaaatttgagccaccaaaatacactgcattacagaaattgccacttgattctgtactcttaacctttggctacttcacagactccattggcaacactgttattgaaaatcatgtaagattaaagagaggcattttcgtttctatacaacttcatttcatacaccttctgcccttacagcacctcatgggatcagaaaagagaaagatgttggctcttgtaataaatgctttctaccctataggttctaggctagacagagtcgtcatttctgtgtcctcaattttatctgaaagattaaaacaaaatatattatgtcactattcagttcatggaggtttgtgctttttcatattttgtgatatataagtagtgaacacacatgttatttacttcaaaagacaggattgacaaattcagtcaatactattttagagattctgttagatgatatgtctgacccaaatttaatccataataaaaaaaaatgggagattgttttcaggaattcagggatgaaaagaaagaataatttccattaagtagaattccagttgtctttctgtttctaaaacacagaacttacaagagccacaggagccaattatagcacctgacagaatacttctcctcttcctcaccttcgggtgcctctagacacttgacttacgatcgttattcccccaattcatcatattttgtttgttatcaccagagatgcctgaactcagttaagcgagcaattgctagttgtcttgaggagcatgaggaattcaggagcagaaggtcaggatagcatgagatagtctcaatgtggccaaccaaaaggacaaaactgacaggaatgcacattcgattttcaagccctccagagcttgaacaacaactttaggagtaaataaaagcctaaaatatattttaaccatccagagatggtgttgaatccttcaacaaatgtgtcattcaaaacagtaattagggaaatcccacagatgaaaaatgccttagtgataagctttcatggcagagcacgtcaagataaatgggtatactggaatccgatgccgtttctacagtaaagtgcaatcttcgttgtttttgtatttatttgtatgttcagatccaaaggatccgttgtaaaaatatatatatataaatatatgtatatccagtgcaatcaactgtcatttctttttccttaaaacatatgagtatatagaaagaaaagttacagtactctgtgggaaaatctcagctgacatcatgaatagaatgaggtctgcttcagaaccttttgttgtcaactgtcactgtttcttccaaaagtcacaatttgtacaagaacctttgctttccttagacttgttctgcattttattttttatttctcaccaaaataaaagcatttatgagaattataagtaaagctttctgtatttcagagagacataagttactagaaagtgaaaagtgaataaataagtcacagagaatgtaaattttgtacagtattagaatgtgtaaatgaagcttgcttggaaggggaaaactttaaataaaaactttatgtactaatt

SEQ ID NO: 244 - DNA, 4933 bp, Homo sapiens
cagaaatgcaacaagtagtacccggggtctgcagagcgccccgcgccgcctgacttggccgggcgaagcccgcctgcagagacccgggccggcctccggacaaaggacggaggaggggctggacggcgctgcgaagtccgaaagaggccatttagcgactctggccaggctaaggggaatgcagaggagacacagagccggcgggccaagaggacgatccggccgctgcacgcagggcgggaggcgatggaggctgcccgcgccttgcgcctcctgctcgtggtgtgcggctgcctcgcgctcccgccgctggccgagcccgtgtgcccggagcgctgcgactgccagcatccccagcatctcctgtgcaccaacagggggctccgcgtagtgcccaagaccagctcgctgccgagcccccacgacgtgctcacctacagcctcggcggcaacttcataaccaacatcacggccttcgacttccaccgtctggggcagctcagacggctggacctgcagtacaaccagatccgctctctgcaccccaagaccttcgagaagctctcgcggctggaagagctgtacctggggaacaacctcttgcaggcgctcgccccgggcacgctggccccgctgcgcaagctgcgcatcctctacgccaacgggaacgagatcagccgcctaagccgcggctccttcgagggcctggagagtctagtcaagctgcggctggacgggaacgccctgggggcgctgccggacgcggtcttcgctcccttgggcaacctgctctacctacatctggagtccaaccggatccgctttctgggcaagaacgccttcgcccagctaggcaagctgcgcttcctcaacctctctgccaacgagctacagccctccctgcgccacgcggccaccttcgcaccgctgcgctccctctcctccctcatcctctcggccaacagcctgcagcacctcgggccgcgcatcttccagcacctgccacgtctcggcctgctctcgctcaggggcaaccagctcacgcacctcgcgcctgaggccttttggggcttggaggccctgcgcgagctgcgcctggagggtaatcggctgagccagctgccaactgcgctgctggagcctctgcacagcctggaggcgctggacctgagcggcaatgagctgtccgccctgcacccggccaccttcggccacctgggccggctgcgcgagctcagcctgcgcaacaacgcgctcagcgccctatccggggacatcttcgccgccagcccagccctttatcggctggatctagacggcaacggctggacctgcgactgccggctgcgaggcctgaagcgctggatgggcgactggcactcgcagggccggctcctcactgtcttcgtgcagtgtcgccaccccccggccctgcgaggcaaatacctggattacctggatgaccagcagctgcaaaatggatcctgcgcggatccctcgccctcagcttccctgaccgctgaccgcaggcggcagcccctacccacggccgcaggggaggagatgacgccacctgcaggtctcgcggaggagctgccgccgcagccgcagctccagcagcaggggcgatttctagctggggtggcctgggatggggccgccagggagctggtaggcaaccgcagcgctctaaggctgagtcggcggggcccgggcctccagcagcccagcccctccgtcgctgccgccgcgggcccggctccacagtccctagacctgcacaagaagccccagcggggccgtccgactcgggcagatcccgccctcgcggagcccaccccaacggcctctcctggctctgcgccatcgcccgccggcgacccctggcagcgcgcgacgaagcatcgtctgggcacggagcaccaggagcgtgccgcccagtccgacggtggggccgggctgccgccgctggtgtccgacccatgcgacttcaacaagttcattctgtgcaacctgacggtggaggcggtgggcgcagacagcgcctcggtgcgctgggccgtgcgcgagcaccgcagtccccggccgctgggcggcgcgcgcttccgcctgctctttgaccgctttggccagcagcccaagttccaccgcttcgtctacctgcctgagagcagcgactcggccacgctgcgcgagctgcgcggggacaccccctacctggtgtgcgtggagggcgtgcttgggggccgtgtctgccctgtggctccccgggaccactgcgcggggctggtcaccctaccggaggccgggagccggggcggcgtcgactaccagctgctgaccttggccctgctgacggtcaacgcgctgctggtgctcctggccttggcggcctgggcgtctcgctggctgcgtaggaaactgcgggctaggcggaagggcggggccccggtccacgttcggcacatgtactccacccgacggcccctgcgctccatgggcaccggcgtgtccgccgacttctcgggattccagtcgcaccggccacgcaccaccgtgtgcgcgctcagtgaggcggacctcatcgaattcccctgcgaccgcttcatggacagtgcgggcggcggcgcgggcggcagcctgagacgggaggaccgtctcctgcagcgatttgccgactaggtccagggcatatagagaccatctcattggccctaaggagccgcctctccgtgaggcccaccagcccacctcaggggaagtgccgttttgtgcacttgccagagaggccggtggggacagagggccaattcgggcaccatcccccaattcccaatactcgagaagtaaatggatggtacttggtggtcagagccagagtaggggacaaatggatggtgggatgctgaggtcggaggcttcgcttggaggctttgacacagctatgcgaatggcttttgtagcactgcaatgcagaagccaggctttgggggtagaaagggggtgcttgtgcccccaacatggccagaaatatttgggtgcatgctttttgtttgctcagtgtcaaacagagaagttttgtttctatttaaggaaggaacttattaccattacaaaggaggcttggccagggactccactggtttggtgatctctgccaagaagggggatgtaaacaggtggtaaagtttaacatacccgccaaggaactcgtttatgttggctgatagagcattcaggataccttaaagtttaataagagacgcatttttttttttcaaaaatgtgaaaagctctgacatttaacgaactgaccaatagactcaaggactgttttagttggactgggccattttattatgttccttttaatattaacagtacaagagcgcttgctgacttcgaggataactaagattacatactttctcaggagaaggctgcatgcaagacttctctgtcagggttgctcctgtggcttttttaattttatttttttaaacctatatatggaaaaggaaatttcaatgccagatttgataaaagaatgtgatgtatatgtagctgatgacccactggggaacaccagtgttccagttcacttaccacatctgtgacagtgtgtttagattggaataaatgtgatgcattacttcttatgtttttatcagtgacatggttgactgtgccctaattctcttgagttgcagttaagcaatgaaggttatttcctaatagggaagcaaaaggtgattgtcaattgatagtttaatgtttgaccacattagtgtctttatatgaaatagtagaggggaagaaattatagaaaacaaatgtgaaaaaaatacaccagtgggtatctgttctactaaaaccagaagattgttatgagtacttaaacctcactgtgaaataatgatatattttgcaattaatccctccccaactgagtgtcttactgtgttattaaatcttatcttttagttaatagttgcagtatttcttttaaatgtttttgttttaaacttaggggtaggatcctttatttgttcagttgtttccaactatttgggatactttcattccctgctatttatgaagtacatgtttatcactaagtgtagtggtttggtttacattaataattttatgtgtggtctaaaaatgcagtcactaagagaatgtacactgtggttatggtcacagtggttatggatttattggcagtggagtaccatggaggtcactgcaatggtgctaaggctgacagtggaatcttctgtttagggccttaagcccctgagggtcctggtgactcagggaatccatcacagccccgggtctttcaccccagttcactccttttatgtttggcctagattgacccatgcctgccctcttctcaacagctgagtagggaaccagccatctgaatgagctgatcgttgtttatgttcaaatgagtaaatgtccagaccacttaaaactacagctgcttttctggcagtctcgtctgcggggccaaaacttaataaaccacaggaaatagactgtcattcttagtttgctgccagggcttattttagattgagagcatactggtacatgagagcagtagtgttgtttgctcttattttcaaccagggagctatctggcaccttttgtgctcctggcttttttcaatcatagcactattgcatctcctagctatttcttttgcccagcagggtaatattgagtcccattgcaagtatggacaaggcctctggttctcctcaccacccaccttttcagccatagaacatcactgaaaatgcctaatgcctggatctgtgttctactttagtttcactgggaagtctttcagtgggagatgaataaatgttatacattgttatgtccagttatgtcaataaacccactaatagagat

SEQ ID NO: 245 - DNA, 1182 bp, Homo sapiens
tagttctccctgagtgagacttgcctgcttctctggcccctggtcctgtcctgttctccagcatggtgtgtctgaagctccctggaggctcctgcatgacagcgctgacagtgacactgatggtgctgagctccccactggctttggctggggacacccgaccacgtttcttgtggcagcttaagtttgaatgtcatttcttcaatgggacggagcgggtgcggttgctggaaagatgcatctataaccaagaggagtccgtgcgcttcgacagcgacgtgggggagtaccgggcggtgacggagctggggcggcctgatgccgagtactggaacagccagaaggacctcctggagcagaggcgggccgcggtggacacctactgcagacacaactacggggttggtgagagcttcacagtgcagcggcgagttgagcctaaggtgactgtgtatccttcaaagacccagcccctgcagcaccacaacctcctggtctgctctgtgagtggtttctatccaggcagcattgaagtcaggtggttccggaacggccaggaagagaaggctggggtggtgtccacaggcctgatccagaatggagattggaccttccagaccctggtgatgctggaaacagttcctcggagtggagaggtttacacctgccaagtggagcacccaagtgtgacgagccctctcacagtggaatggagagcacggtctgaatctgcacagagcaagatgctgagtggagtcgggggcttcgtgctgggcctgctcttccttggggccgggctgttcatctacttcaggaatcagaaaggacactctggacttcagccaacaggattcctgagctgaaatgcagatgaccacattcaaggaagaaccttctgtcccagctttgcagaatgaaaagctttcctgcttggcagttattcttccacaagagagggctttctcaggacctggttgctactggttcggcaactgcagaaaatgtcctcccttgtggcttcctcagctcctgcccttggcctgaagtcccagcattgatgacagcgcctcatcttcaacttttgtgctcccctttgcctaaaccgtatggcctcccgtgcatctgtactcaccctgtacgacaaacacattacattattaaatgtttctcaaagatggagtt

SEQ ID NO: 246 - DNA, 1828 bp, Homo sapiens
cagttacagggagcaccaccagggaacatctcggggagcctggttggaagctgcaggcttagtctgtcggctgcgggtctctgactgccctgtggggagggtcttgccttaacatcccttgcatttggctgcaaagaaatctgcttggaagaaggggttacgctgtttggccgggcagaaactccgctgagcagaacttgccgccagaatgctcctcctgttgctgagtatcatcgtcctccacgtcgcggtgctggtgctgctgttcgtctccacgatcgtcagccaatggatcgtgggcaatggacacgcaactgatctctggcagaactgtagcacctcttcctcaggaaatgtccaccactgtttctcatcatcaccaaacgaatggctgcagtctgtccaggccaccatgatcctgtcgatcatcttcagcattctgtctctgttcctgttcttctgccaactcttcaccctcaccaaggggggcaggttttacatcactggaatcttccaaattcttgctggtctgtgcgtgatgagtgctgcggccatctacacggtgaggcacccggagtggcatctcaactcggattactcctacggtttcgcctacatcctggcctgggtggccttccccctggcccttctcagcggtgtcatctatgtgatcttgcggaaacgcgaatgaggcgcccagacggtctgtctgaggctctgagcgtacatagggaagggaggaagggaaaacagaaagcagacaaagaaaaaagagctagcccaaaatcccaaactcaaaccaaaccaaacagaaagcagtggaggtgggggttgctgttgattgaagatgtatataatatctccggtttataaaacctatttataacactttttacatatatgtacatagtattgtttgctttttatgttgaccatcagcctcgtgttgagccttaaagaagtagctaaggaactttacatcctaacagtataatccagctcagtatttttgttttgttttttgtttgtttgttttgttttacccagaaataagataactccatctcgccccttccctttcatctgaaagaagatacctccctcccagtccacctcatttagaaaaccaaagtgtgggtagaaaccccaaatgtccaaaagcccttttctggtgggtgacccagtgcatccaacagaaacagccgctgcccgaacctctgtgtgaagctttacgcgcacacggacaaaatgcccaaactggagcccttgcaaaaacacggcttgtggcattggcatacttgcccttacaggtggagtatcttcgtcacacatctaaatgagaaatcagtgacaacaagtctttgaaatggtgctatggatttaccattccttattatcactaatcatctaaacaactcactggaaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgtttttgctttgcattttctgattttataccaactgtgtggactaagatgcattaaaataaacatcagagtaactc

SEQ ID NO: 247 - DNA, 744 bp, Homo sapiens
ggaagcggagggggagcaggtttgcggggccaagtgttgcggcgacgcacctcacgtcgagaatcgggaggaggagactgcaaggataggcccaggagtaatggagtccaaagaggaacgagcgttaaacaatctcatcgtggaaaatgtcaaccaggaaaatgatgaaaaagatgaaaaggagcaagttgctaataaaggggagcccttggccctacctttgaatgttagtgaatactgtgtgcctagaggaaaccgtaggcggttccgcgttaggcagcccatcctgcagtatagatgggacataatgcataggcttggagagccacaggcaaggatgagagaggagaatatggaaaggattggggaggaggtgagacagctgatggaaaagctgagggaaaagcagttgagtcatagtctgcgggcagtcagcactgatccccctcaccatgaccatcacgatgagttttgccttatgccctgaatcctgatggtttccctgaagttaatagggagacccctgcttcctaaacttacacatttgtggtgtacctttgtcgtaaacgttttgatgttacctatttcttgtgggtctcctattaccagcttctaaatgaatgttgtttttgacccagtttgtaagtttctgtcagcaggagagttttacctattgcatggaaggatgctcattatatattgtgaagttaataaaacagttttaaaaagcaaaaaaaaaaaaaa

SEQ ID NO: 248 - DNA, 300 bp, Homo sapiens
gctttttaaaactgttttattaacttcacaatatataatgagcatctttccatgcaataggtaaaactctcctgctgacagaaacttacaaactgggtcaaaaacaacattcatttagaagctggtaataggagacccacaagaaataggtaacatcaaaacgtttacgacaaaggtacaccacaaatgtgtaagtttaggaagcaggggtctccctattaacttcagggaaaccatcaggattcagggcataaggcaaaactcatcgtgatggtcatggtgggggggatcagtgctgac

SEQ ID NO: 249 - DNA, 319 bp, Homo sapiens
tttttttgcagccaaatacagtttatttttttctctctcagctgaggagcagacacatttacggagatgcaaatgaccatccagtggcctacagtggagggggggtggagggagtaggggattagggggttggtagggagtgttgggggagggaggagcacagggctggctcagggccaggatctgtgaacggggcagggctctgtcaacatttacccagtccatccccagagagggctgcaaaaggggacggcgatagaaaagtagatggaatactttgggatgggggacaacttacatgcaagaaaaggagggaact

SEQ ID NO: 250 - DNA, 331 bp, Homo sapiens
ctagcaatttattttagattcacaagtgaattagacacatttttatcatttacaaaatgctattttccttaacatcaacctttcaggtggttcagaaggtacatgggatactgcattaaaagacttaatgcagcgtctggaacaaagtcagcttgatataaacttgggctgtaatttgttgtttttatgactattacatttgattgttttttaactaacttgtcttggattttttccctgttaagtgtcaattggttgagacaggtccattttgagaatgacagagcacacataaactttgggacctgattatgggaagaattaggttcat

SEQ ID NO: 251 - DNA, 21 bp, Artificial Sequence
  Synthetic PCR Primer AEK M13F
gttgtaaaacgacggccagtg

SEQ ID NO: 252 - DNA, 19 bp, Artificial Sequence
  Synthetic PCR Primer AEK M13R
cacacaggaaacagctatg

SEQ ID NO: 253 - DNA, 22 bp, Artificial Sequence
  Synthetic Oligo Primer
  misc_feature (22)..(22): n is a, c, g, or t
ttttttttttttttttttttvn

SEQ ID NO: 254 - protein, 383 aa, Homo sapiens
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNGTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPNGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 255 - protein, 247 aa, Homo sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTAPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 256 - protein, 1523 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVADVQKKEYVCPAPHSEPPSCNANSISCPSPCTCSNNIVDCRGKGLMEIPANLPEGIVEIRLEQNSIKAIPAGAFTQYKKLKRIDISKNQISDIAPDAFQGLKSLTSLVLYGNKITEIAKGLFDGLVSLQLLLLNANKINCLRVNTFQDLQNLNLLSLYDNKLQTISKGLFAPLQSIQTLHLAQNPFVCDCHLKWLADYLQDNPIETSGARCSSPRRLANKRISQIKSKKFRCSGSEDYRSRFSSECFMDLVCPEKCRCEGTIVDCSNQKLVRIPSHLPEYVTDLRLNDNEVSVLEATGIFKKLPNLRKINLSNNKIKEVREGAFDGAASVQELMLTGNQLETVHGRVFRGLSGLKTLMLRSNLIGCVSNDTFAGLSSVRLLSLYDNRITTITPGAFTTLVSLSTINLLSNPFNCNCHLAWLGKWLRKRRIVSGNPRCQKPFFLKEIPIQDVAIQDFTCDGNEESSCQLSPRCPEQCTCMETVVRCSNKGLRALPRGMPKDVTELYLEGNHLTAVPRELSALRHLTLIDLSNNSISMLTNYTFSNMSHLSTLILSYNRLRCIPVHAFNGLRSLRVLTLHGNDISSVPEGSFNDLTSLSHLALGTNPLHCDCSLRWLSEWVKAGYKEPGIARCSSPEPMADRLLLTTPTHRFQCKGPVDINIVAKCNACLSSPCKNNGTCTQDPVELYRCACPYSYKGKDCTVPINTCIQNPCQHGGTCHLSDSHKDGFSCSCPLGFEGQRCEINPDDCEDNDCENNATCVDGINNYVCICPPNYTGELCDEVIDHCVPELNLCQHEAKCIPLDKGFSCECVPGYSGKLCETDNDDCVAHKCRHGAQCVDTINGYTCTCPQGFSGPFCEHPPPMVLLQTSPCDQYECQNGAQCIVVQQEPTCRCPPGFAGPRCEKLITVNFVGKDSYVELASAKVRPQANISLQVATDKDNGILLYKGDNDPLALELYQGHVRLVYDSLSSPPTTVYSVETVNDGQFHSVELVTLNQTLNLVVDKGTPKSLGKLQKQPAVGINSPLYLGGIPTSTGLSALRQGTDRPLGGFHGCIHEVRINNELQDFKALPPQSLGVSPGCKSCTVCKHGLCRSVEKDSVVCECRPGWTGPLCDQEARDPCLGHRCHHGKCVATGTSYMCKCAEGYGGDLCDNKNDSANACSAFKCHHGQCHISDQGEPYCLCQPGFSGEHCQQENPCLGQVVREVIRRQKGYASCATASKVPIMECRGGCGPQCCQPTRSKRRKYVFQCTDGSSFVEEVERHLECGCLACS

We claim:

1. A method of predicting the outcome of a patient having neuroblastoma comprising detecting an increase in expression of at least one gene or group of genes selected from the group consisting of PRSS3; PRSS3 and DLK1; PRSS3 and SLIT3; and PRSS3, DLK1, and SLIT3, in a neuroblastoma cell from the patient, wherein an increase in expression of at least one of the genes is indicative of poor outcome of the subject.

2. The method of claim 1, wherein the DLK1 gene comprises Image ID NO: 296815 or Image ID NO: 436121.

3. The method of claim 2, wherein the DLK1 gene comprises SEQ ID NO:1.

4. The method of claim 1, wherein the SLIT3 gene comprises Image ID NO: 450382, Image ID NO: 192225, or Image ID NO: 2030301.

5. The method of claim 1, wherein the SLIT3 gene comprises SEQ ID NO:6.

6. The method of claim 1, wherein the PRSS3 gene comprises Image ID NO: 1913366.

7. The method of claim 1, wherein the PRSS3 gene comprises SEQ ID NO:3.

8. The method of claim 1, wherein the neuroblastoma cell does not have an amplification of MYCN.

9. The method of claim 8, wherein an increase in expression of at least one of the genes comprises detecting expression using micro array analysis.

10. The method of claim 1, wherein the expression of at least one of the genes is detected by detecting an increase in mRNA.

11. The method of claim 1, wherein detecting an increase in expression comprises detecting an increase in serum levels of a polypeptide encoded by at least one of the genes.

12. The method of claim 1, further comprising detecting expression of MYCN.

13. The method of claim 1, further comprising detecting expression of CD44.

14. The method of claim 1, further comprising detecting expression of one of the genes selected from the group consisting of MYCN, ARC, JPH1, Hs. 434957, Hs. 346735, Hs. 120591, CD44, ARH1, CNR1, ROBO2, BTBD3, KLRC3, Hs. 196008, Hs. 124776, Hs. 119947, Hs. 349094.

15. The method of claim 14, wherein the gene MYCN comprises Image ID NO: 41565.

16. The method of claim 14, wherein the gene MYCN comprises SEQ ID NO:16.

17. The method of claim 14, wherein the gene for CD44 comprises Image ID NO: 1967589.

18. The method of claim 14, wherein the gene for CD44 comprises SEQ ID NO:12.

19. The method of claim 14, wherein
a) a gene DLK1 comprises Image ID NO: 296815 or 436121;
b) a gene PRSS3 comprises Image ID NO: 1913366;
c) a gene ARC, comprises Image ID NO: 222457;
d) a gene SLIT3 comprises Image ID NO: 450382, or Image ID NO: 192225, or Image ID NO: 2030301;
e) a gene JPH1 comprises Image ID NO: 811874;
f) a gene ARH1 comprises Image ID NO: 2336916;
g) a gene CNR1 comprises Image ID NO: 26295;
h) a gene ROBO2 comprises Image ID NO: 377573;
i) a gene BTBD3 comprises Image ID NO: 811918;
j) a gene KLRC3 comprises Image ID NO: 2361911;
k) Hs. 434957 comprises Image ID NO: 681891;
l) Hs. 346735 comprises Image ID NO: 143169;
m) Hs. 120591 comprises Image ID NO: 1540478;
n) Hs. 196008 comprises Image ID NO: 111264;
o) Hs. 124776 comprises Image ID NO: 1574206;
p) Hs. 119947 comprises Image ID NO: 379779; and
q) Hs. 349094 comprises Image ID NO: 687667.

20. The method of claim 14, wherein
a) a gene DLK1 comprises SEQ ID NO:1;
b) a gene PRSS3 comprises SEQ ID NO:3;
c) a gene ARC comprises SEQ ID NO:5;
d) a gene SLIT3 comprises SEQ ID NO:6;
e) a gene JPH1 comprises SEQ ID NO:18;
f) a gene ARH1 comprises SEQ ID NO:4
g) a gene CNR1 comprises SEQ ID NO:7;
h) a gene ROB02 comprises SEQ ID NO:14;
i) a gene BTBD3 comprises SEQ ID NO:15;
j) a gene KLRC3 comprises SEQ ID NO:19;
k) Hs. 434957 comprises SEQ ID NO:11;
l) Hs. 346735 comprises SEQ ID NO:8;
m) Hs. 120591 comprises SEQ ID NO:2;
n) Hs. 196008 comprises SEQ ID N09;
o) Hs. 124776 comprises SEQ ID NO:17;
p) Hs. 119947 comprises SEQ ID NO:10; and
q) Hs. 349094 comprises SEQ ID NO:13.

21. The method of claim 14, wherein the expression of DLK1 (SEQ ID NO: 1), EST (SEQ ID NO: 2), PRSS3 (SEQ ID NO: 3), ARHI (SEQ ID NO: 4), ARC (SEQ ID NO: 5), SLIT3 (SEQ ID NO: 6), CNR1 (SEQ ID NO: 7), EST (SEQ ID NO: 8), EST (SEQ ID NO: 9), FLJ25461 (SEQ ID NO: 10), EST (SEQ ID NO: 11), CD44 (SEQ ID NO: 12), EST (SEQ ID NO: 13), ROBO2 (SEQ ID NO: 14), BTBD3 (SEQ ID NO: 15), MYCN (SEQ ID NO: 16), EST (SEQ ID NO: 17), JPH1 (SEQ ID NO: 18), and KLRC3 (SEQ ID NO: 19) are detected.

22. The method of claim 21, further comprising detecting expression of at least one or all genes selected from the group consisting of EST (SEQ ID NO: 20), RET (SEQ ID NO: 21), CRABP1 (SEQ ID NO: 22), ECEL1 (SEQ ID NO: 23), LOC283120 (SEQ ID NO: 24), HMGA2 (SEQ ID NO: 25), SNYPO2 (SEQ ID NO: 26), LOC163782 (SEQ ID NO: 27), VSNL1 (SEQ ID NO: 28), HS3ST4 (SEQ ID NO: 29), AKR1C1 (SEQ ID NO: 30), EST (SEQ ID NO: 31), GPR22 (SEQ ID NO: 32), EST (SEQ ID NO: 33), EST (SEQ ID NO: 34), CCNA1 (SEQ ID NO: 35), PK1B (SEQ ID NO: 36), EST (SEQ ID NO: 37), GAL (SEQ ID NO: 38), EST (SEQ ID NO: 39), LOC221303 (SEQ ID NO: 40), EST (SEQ ID NO: 41), EST (SEQ ID NO: 42), BMP7 (SEQ ID NO: 43), SLC30A3 (SEQ ID NO: 44), FLJ10539 (SEQ ID NO: 45), AMIGO2 (SEQ ID NO: 46), AKR1C2 (SEQ ID NO: 47), MGP (SEQ ID NO: 48), PCSK1 (SEQ ID NO: 49), HK2 (SEQ ID NO: 50), EST (SEQ ID NO: 51), EST (SEQ ID NO: 52), IL7 (SEQ ID NO: 53), PRSS12 (SEQ ID NO: 54), GABARAPL (SEQ ID NO: 55), DEFB129 (SEQ ID NO: 56), NAV3 (SEQ ID NO: 57), RAB3B (SEQ ID NO: 58), KRT6B (SEQ ID NO: 59), BEX1 (SEQ ID NO: 60), EST (SEQ ID NO: 61), EST (SEQ ID NO: 62), SCYL1 (SEQ ID NO: 63), EST (SEQ ID NO: 64), RYR2 (SEQ ID NO: 65), LRBA (SEQ ID NO: 66), CSPG3 (SEQ ID NO: 67), EST (SEQ ID NO: 68), MMP12 (SEQ ID NO: 69), CHRNA1 (SEQ ID NO: 70), EST (SEQ ID NO: 71), EST (SEQ ID NO: 72), HNRPH1 (SEQ ID NO: 73), LOC113251 (SEQ ID NO: 74), EST (SEQ ID NO: 75), PAG (SEQ ID NO: 76), PROK2 (SEQ ID NO: 77), HS6ST1 (SEQ ID NO: 78), EST (SEQ ID NO: 79), PCDH9 (SEQ ID NO: 80), EST (SEQ ID NO: 81), EST (SEQ ID NO: 82), GLDC (SEQ ID NO: 83), ADRB2 (SEQ ID NO: 84), ICSBP1 (SEQ ID NO: 85), CD48 (SEQ ID NO: 86), EST (SEQ ID NO: 87), DYRK1B (SEQ ID NO: 88), KLRC1 (SEQ ID NO: 89), EST (SEQ ID NO: 90), EST (SEQ ID NO: 91), EST (SEQ ID NO: 92), MOXD1 (SEQ ID NO: 93), EST (SEQ ID NO: 94), EST (SEQ ID NO: 95), GAS1 (SEQ ID NO: 96), COL9A2 (SEQ ID NO: 97), EST (SEQ ID NO: 98), DRPLA (SEQ ID NO: 99), EST (SEQ ID NO: 100), REPRIMO (SEQ ID NO: 101), CACNA2D2 (SEQ ID NO: 102), NEBL (SEQ ID NO: 103), EST (SEQ ID NO: 104), HLA-DQA1 (SEQ ID NO: 105), EDG3 (SEQ ID NO: 106), CPVL (SEQ ID NO: 107), FLJ32884 (SEQ ID NO: 108), LCP1 (SEQ ID NO: 109), EST (SEQ ID NO: 110), EST (SEQ ID NO: 111), EST (SEQ ID NO: 112), EST (SEQ ID NO: 113), DKFZP564C152 (SEQ ID NO: 114), DMN (SEQ ID NO: 115), GABRA5 (SEQ ID NO: 116), AKR1C3 (SEQ ID NO: 117), LOC168850 (SEQ ID NO: 118), EST (SEQ ID NO: 119), KCNQ2 (SEQ ID NO: 120), NME5 (SEQ ID NO: 121), EST (SEQ ID NO: 122), PBX1 (SEQ ID NO: 123), CNTNAP2 (SEQ ID NO: 124), EST (SEQ ID NO: 125), SPON1 (SEQ ID NO: 126), CDH8 (SEQ ID NO: 127), PRKCB1 (SEQ ID NO: 128), SLC21A11 (SEQ ID NO: 129), MAP4 (SEQ ID NO: 130), EST (SEQ ID NO: 131), SCN7A (SEQ ID NO: 132), EST (SEQ ID NO: 133), EST (SEQ ID NO: 134), EST (SEQ ID NO: 135), EST (SEQ ID NO: 136), CDW52 (SEQ ID NO: 137), ARCB1 (SEQ ID NO: 138), EST (SEQ ID NO: 139), OST-2 (SEQ ID NO: 140), NRXN1 (SEQ ID NO: 141), ADAM22 (SEQ ID NO: 142), EST (SEQ ID NO: 143), TRGV9 (SEQ ID NO: 144), EST (SEQ ID NO: 145), PTPRD (SEQ ID NO: 146), EST (SEQ ID NO: 147), HS3ST2 (SEQ ID NO: 148), FGF13 (SEQ ID NO: 149), MKI67 (SEQ ID NO: 150), KIF12 (SEQ ID NO: 151), EST (SEQ ID NO: 152), EST (SEQ ID NO: 153), EST (SEQ ID NO: 154), EST (SEQ ID NO: 155), EST (SEQ ID NO: 156), KLIP1 (SEQ ID NO: 157), EST (SEQ ID NO: 158), LOC157570 (SEQ ID NO: 159), MAD2L1 (SEQ ID NO: 160), EST (SEQ ID NO: 161), EST (SEQ ID NO: 162), RGS5 (SEQ ID NO: 163), ATP2B4 (SEQ ID NO: 164), HMGCL (SEQ ID NO: 165), ODZ3 (SEQ ID NO: 166), CHGA (SEQ ID NO: 167), MGC33510 (SEQ ID NO: 168), GAGE5 (SEQ ID NO: 169), SARDH (SEQ ID NO: 170), EST (SEQ ID NO: 171), DAT1 (SEQ ID NO: 172), FUCA1 (SEQ ID NO: 173), TM6SF2 (SEQ ID NO: 174), KCNK9 (SEQ ID NO: 175), ADCYAP1 (SEQ ID NO: 176), PLXNA4 (SEQ ID NO: 177), HLA-DMB (SEQ ID NO: 178), EST (SEQ ID NO: 179), EST (SEQ ID NO: 180), GRIN3A (SEQ ID NO: 181), OSBPL3 (SEQ ID NO: 182), ODZ4 (SEQ ID NO: 183), EST (SEQ ID NO: 184), E2F1 (SEQ ID NO: 185), MGC16664 (SEQ ID NO: 186), HMP19 (SEQ ID NO: 187), IL2RB (SEQ ID NO: 188), TOPK (SEQ ID NO: 189), ALDH1A1 (SEQ ID NO: 190), CED-6 (SEQ ID NO: 191), EST (SEQ ID NO: 192), A2BP1 (SEQ ID NO: 193), LY6E (SEQ ID NO: 194), EST (SEQ ID NO: 195), EST (SEQ ID NO: 196), PLXNC1 (SEQ ID NO: 197), EFS (SEQ ID NO: 198), ACTN2 (SEQ ID NO: 199), MYC (SEQ ID NO: 200), KIAA0527 (SEQ ID NO: 201), C6orf31 (SEQ ID NO: 202), DLL3 (SEQ ID NO: 203), EST (SEQ ID NO: 204), STK33 (SEQ ID NO: 205), SEMA3A (SEQ ID NO: 206), EST (SEQ ID NO: 207), IGSF4 (SEQ ID NO: 208), CKS2 (SEQ ID NO: 209), EST (SEQ ID NO: 210), EST (SEQ ID NO: 211), SIX3 (SEQ ID NO: 212), F1122002 (SEQ ID NO: 213), HSD17B12 (SEQ ID NO: 214), HBA2 (SEQ ID NO: 215), CDH11 (SEQ ID NO: 216), RGS9 (SEQ ID NO: 217), EST (SEQ ID NO: 218), NCAM2 (SEQ ID NO: 219), BIRC5 (SEQ ID NO: 220), EST (SEQ ID NO: 221), GNG12 (SEQ ID NO: 222), GPIG4 (SEQ ID NO: 223), EST (SEQ ID NO: 224), ENPP4 (SEQ ID NO: 225), FMNL (SEQ ID NO: 226), EST (SEQ ID NO: 227), PIWIL2 (SEQ ID NO: 228), CLSTN1 (SEQ ID NO: 229), UHRF1 (SEQ ID NO: 230), EST (SEQ ID NO: 231), SLC40A1 (SEQ ID NO: 232), CLECSF6 (SEQ ID NO: 233), EST (SEQ ID NO: 234), BKLHD2 (SEQ ID NO: 235), EST (SEQ ID NO: 236), EST (SEQ ID NO: 237), EST (SEQ ID NO: 238), SORCS1 (SEQ ID NO: 239), NRP2 (SEQ ID NO: 240), E2-EPF (SEQ ID NO: 241), CAST (SEQ ID NO: 242), KIAA1384 (SEQ ID NO: 243), KIAA0644 (SEQ ID NO: 244), HLA-DRB3 (SEQ ID NO: 245), PMP22 (SEQ ID NO: 246), DJ9P11.1 (SEQ ID NO: 247), SOX5 (SEQ ID NO: 248), CD3E (SEQ ID NO: 249), and EST (SEQ ID NO: 250).

23. The method of claim 14, wherein the expression of the gene is detecting mRNA.

24. The method of claim 23, wherein the mRNA is detected using microarray analysis.

* * * * *